United States Patent 9,486,487 (METHODS AND COMPOSITIONS RELATING TO MICROBIAL TREATMENT AND DIAGNOSIS OF DISORDERS) - sequence listing, part 9

SEQ ID NO: 10 - DNA, 6402828 bp, Clostridium indolis WBS-01 (residues 1-2,134,276 of 6,402,828)
tcttttggctcatatgaacccatgtgccaacgaatggcatatctttcagccggtaacagttttatgtattcctcaatcatcatgacactcttctcgccatgcccgtagggtatgaggtcattcactgtataaaagggaaccgacaccaagcaccggattcatcttttttgttccgcatttccgtggtgtagaaatagttttgcaaaggtcatggagtaaaaagagattacaatactttcactctgtacatttactaatatttgtgccaaaaacaaaccgccctcatacgctccatggaatctggtactggccggagccgtataaaatcactcttgcgaataaattcaagaaggttttcaattcccggacgctttgtttccaataacaacttttcgaatctttcaactaattcctggttcactgtttttctcactttcttttctgattgccttatgaaatgctcccctgtcaagccaaactgcgtatgtttaatgacttcaatgtgccttgtctggtgataccacataacccacttttgtttcaaaagttcatcaagtgatgtgattggaacaccttccataaataatcgtttagatttcagataatccttgtgtttcttgatattttcacattcagcacaaggcgattcgtaagacgggtaatgtttgccattatgctcccaactcaaagcacaatatctacaaggattctgtttcataaatcctccttaatctcggtcaatcgcaatatgaccagttgcaatgagggcagccagtgattaactcactcccggccttttcaaccgatatccccttggataaatttccgctacgatttttaccttcagcataaatctgctgattgcatctccagcaaataccactttcgggagcgaaataagggtagttatactctttacaataatgctcctgtgctattctggaagaatatacattgaaatgctcattggtcatacttcctgtgcctcctctgctggctccttgccatcaataaccttgatattttcctcaccataggaatttacccattccatgtcaattttcccatcaacgacgatcccatggccgccgccgggcaaaagaaccttgtcaccggggactacaggttcagaggaacgaaaagtgtatgtaccgccagatggttttccgtttttgatgtaccttgctttaattaactgcatttagatttcctccatttccttttcaagactcctaatttgctcatcaatgatacttttaaattcattgattaatcgcttcatgcttaaagcaccaaggtcagtattgtcggcaatcactccactcccataggaaagtctaaattctacagtgtagcattccggcggcagattgatggacttttttaaatcattcaaatgttttatctgctgcatgattggttcagctttttcaaattgtgcttttttcaccttagcttttcctccactttttcccaacaattcagcgactttattcagatgtaccatatcctcatctgtcagacgattagccaccgcaattaatatttttattgcatgaatgagctccgatatacgaatctgactgtcattggtcatcatttaatctcaaccatcaactctttgttatcagctcggctcattacgattaattgactgtcacataccgggagccgccatggatcaaggctctccccatcatcaagaataaccggacactgaatacccacgattttctgaatggtcagggcgataatcatcatggcttcaatcttcctgccgtggttcgccgtattgtcatggatctcatagccgtcaatccttggaacacaataatcttttttatatccaccgttcttagcaaaggcaaataaatcccatgtcaccctaccgccgaagtagctgttaattgaatcaaccaaaagttcatttttcttttggtcaagctgatccagcaaatcaaggattctttcacaattagcctttgactgttctttctgcaactgctcattccgcaggaaggttaacctctcttccagttccacattcttagccattctggtaattttctctttcacagaatccagttcggcctgaatttcggctttctggttccgaagcgtagcccgataatcggcacccgtatttacggcccttaaagcttcttcctttttggcaatctcctggcaaagggcttcatattcctggttctctgataaatctatctgagtggggagtgcattcatttcttccagcgccttattctttgcactattggcagtaaccttctgttcatttgcagattttaaacggttttcgacctcagcaagatcaatactttccagattttcaatgtccgcttttaacgttctgcctttttcagaaatggaagttaaaagatctaatttccgctgctcccattcctttttatcattatcatactgctgacggtgtcgctggctgtttacctcatactgttcctgcttttgattcttaactgactctggcaaatcctgcccgcaagtagggcaaataaatatatcagaacccaaatcaggtagtggcgtataagaaggaaaaacattctgtgaaacattggtgtattcaactaataaactggccttctgctccgtttttcgctttatagcctccaataccctctgcttatccatttcagccatagttgaatcattcatagccttcctaaactgcatttctgctgcatcaatgcgcctttggatttctttcttctgctccattagtttcgaattgcctgtccgttctatttccgaacgtttaaactgtaattccatgatatccttggtcctggaatcatgcagtttagcctgcgcaagtgaatcttcttcctgcttttcgatatttgaaatttgatgctgcaattcatttttctgtaattccaactccgcagtatcaatgtcctctacgatttgacgattaacttcatcaatacgaccaggatacccagctatctccttattcaatttcagtacactggccttattcatggaagaaatctcatcaatgttatacttctcaagcaatggtaccagatctgcaaattccgaatattttttcacaatgtcgttaatggaaatatcctgcggcagcttgaagagaaattctctcatttcctttggtttctttgccaggaatgctccgatattcatgcacatgagcagatcgtcgaaatcaaagtcaaaatatccgatgaaatcttttaagttcttctccacaccattgatggaatatgtattatcatcagaatagctaccgtcttttttagtggtccgtttctggactttcttcgcaatgatttctttcccatcaacttccatagtgatttcaccgaccaccgggacatctgccacagggatcttgtcaacttcccggcgcaccttcggattactggtcaggtcattgcctaccccatgaagcacccacataagcaattcggcaatgctggacttacccaggccgtttgcacctctaatatgggtaatcttgtccccaaactgcacatcaaagcttttgaatcccttgaagttttcgcagtgtgcactaatcaactttactacatgcatttcaattttcctccctcaaactcttaataaatttctggacagccaaaatcatatcatcttccaaagtctgatacggatccgtccctttctccggattggattccggcattactacctgcatttcagacgaattttcttccatttcttcttgcttcaaacgataatagagaagatttaacaaattggaattagtagcattatcaatggataaatacttttcaaccaatgaaagtttcccctttgttactacaattccaaacgcatggcggatagctctctcaacgccagtaccggttgtgttatgccttttagcaatctcttcatataaggccatgattttaatgccacaaaattcggaatcaaatagtcccatagcttcagctatgtattcaagcccattgaccgaagctggcattcccattttaatcaaaatatcttttgctctatcttttatcatcttccggtacctccatctttgaaacggaaacctcataagcagtgcgctttatttctttcgtgtcactgagtttcttaatgtactcccggctctgaattcttccatatatttccagtcgagtgccgacaaaaagccctgaggcgtattttgcgtttctcccccatgtaatgcaagggatataatctgatttggcatacggacggtttaccgccagaagcaaatctgcaatttctctccctaatggagtttttcgataaaccggaggcttgcacaagaaaccatttaatgtgattaaatttgtcttggtgtaatctgtaaattcctcttccaaaaaattaacttctcttacgaacaccgaaagaataagtctctttctttctggtccagactggttgtaagagcgaaactgtccgatgacctcaatcgtgtcacccatggaaatctcgtttttatcaatcaggcgttctgagatcgtaagcggaataatgtcaacctgttcactgagacgcttaacagaaaggtccactgtatagaatccttcaccaaacacctcatggctgtatgtaaatccggaaacaatctctccgattaatgtaacagtattattctgtatagtactcatattgtctgttatcctccttatttaagttctaaatctctttttatgttctcgtacatcagttttaaaataagagcctgtgccattttattttcatttgcctttttaactgtctctgaaaccaaacattcacagccaaaaagtaaaacagatacatgtccctccattttgattttcgtggttgcgtccattccatttctttctcaaaagaaattgtcgcaggtgcttcgcttatttctttattccggtccgtcatccgctccataagaaccgcttttaataattcatccatcttgattttctccgttctcccctgtataatagaggtgtaaattaattttcagttaccttgattccctgggagtagccgctcctggggtttctactttttcagccatatcaaccatggtaaggcctcttagaatggcactaatccattgattttccatgctccagttaacctgaactggtccgtgatcatcaatagcctgtaaaatgatctcagctattttccgcttgtccatcacagatcctccttaagagccttctgaatatctctgatatatcgtctgatatctccagttttctccggacctagatctgcacttaattcctctacttctttagcaatggtagataataaatctaaaaggactgtctgcgggtaatactttttaagaagcacgccttcttctgttactaagatttccatgggggaaccttcggtcactcttatgtttcgccgtatctcccttggaataacaatcctcccaagatcgtcaattcttcttatgatgccagttgacttcatgatttttctcctttcttatcatcagcaaatggatcagggcaaaacaccttatcacgccatgtcagtttcttgaaatttgcttcacacgttggacatttgtggcctacaataacggcatctgccgcaccgggataataacctcccaagctatcacccatctgatctccacatcttgcacaattaaaatatccgaagcaaaatgtctgaattttactgtgcccgataaggctacaggtaatttctttcttctggtcctcatcagtaacgcctagagcatctagttttttcagtaatacttcttcactctgaatttctatctttgccatcttccctcacctcatctcaatcttcatcttctgttccaacaattcggccatcattaatacataccggataccagttttcaagcataatctgtttgtccatctcaaaaactggaactaaattgatatctgtctgctctgcatttgtaaatctgctcattttccattcacctcctccttgtccatcgtgcccgccatatcaggcggttccgctttgcttttccatgagctgtctttccaatgctctggatacaattttccccgcattttcgagaatctctttttttctcacttcatcgacaaggtagtcatcatgaatttcaattgtacaattatcaaacttgtattcctttactttcataaagcacctctttttaatccctttaattgatactatgtggtacggtttgtacttgtttccagccagacactacgtccttatataatgagttcaacgaaatattggcaactttactgcaaacacagcaaaaacgaatcccaatatgatggtatacagcagtcccattctcccccaacctacctcgctgtgaccgtgccaatatgacatgatacacaacaggcaggtcattaaatacacaggtactatattccaagcattcacagaattaaatctcacctccccgcttatctccccttttttcattgacacgtccatatgatagtggtatattataagcattcgaacgtgtgttctttgtattaggctgacaacttctctttatcaaacaaccagttgaagtcatactcggggaaaaacactttcttcattagtagcgcctcgctaacggtaaactctgtttttaccactcctttgcacctctctgagactgtccttaactgacattgaagcagttcagatatttgcgtgaacgttatttttttctcattcattgcaaacagaaggtttttatacatattctcacctccaatcatctgcgcaactgcgctaaccttgcttatatgatacgctcaattgcacgtattgtcaagggctttattcgtgcaattgcatgaatattttaatccatgatcacatttgcgtatttgcgaaaattttgctttactttttgcgtaattgcgcgtatactattattgtattaagtgaggtggaaaaatggaaaaagctagaatattagaaaaattgattaatgatactggactcagcaaaagagcctttgcagaaaaatgtggtatttcagagagtactctttattctattttaaaaagaggtgtcggtggagctagtgttaacatcgttatatccatttgtaaagaattgggtattactgttgaagggttagatgaaatggcaaaaggtgcagcaaaaactatacatgagccgacttatgaagacatccaaagtcttatcgccaggaacggaaagaaactcacgcttgaacaaaaacaggacattataagaactctactgtccgatgattaaagggtgattttgttggagcaatgcagaattattgaaaagacattagaagtgtacaagaaatgcaatattaaaagtttccctattgattgctttaagattatcaaaggtttagggattccattatacaaatattcggaactccctgggcctaaagccagaaagtgtcttttggttagtaatgacgcttttactcttcaaggtgtaattttttataacgatgaatttccccacaaagaacgacaacgtttttcattgatgcatgaagttggtcatattgttcttaatcatgtgggagaatgcccaaaaaatgagaaagaggctgacttcttttccagtaatatattggctcccaggccaatcatgcagtatttgcattgtgaatcggtaaaggacatctataatacatttaatgtttcatgtatggctgctaaccggatagcaagagattataaaattgattatgtaaggataaagagcgatttacataaaagtatttgcaactggtttttcccacgtaatatttctgatatcccaatccaaatagatccggtacctgaatgctcaacatatgattccaatttctttagtactcatcgatttcttatgggtgaaggatatatttttgaacaagcggagttttaccatttgcatggtcatgggttttaataaaaaaacaaaagaaagaggaaaatgagtatgattgattttaaaaatggatcctttgtaaaattaaaaaaagtagataattctatagcagatggagttaccaagctttatatctctggtgaggagacgataggatgctacaaaggaatgcgcgattatgttgtttttacgaataagcgtattatctctgtaaatgttcaaggaatgacaggcacaaagaaagatttcacttcgatgccatattccaaaatacaagtattttccgtagaaacatctggggtatttgatttagacagtgaattagaagtatatttcagtggcgcaggtaaagtaaaatttgaatttacaggttcatgtgatatagaacgaataggtcaacttatagcttcttatactttatagactaataaacagcaaaaaccgcccagtgctaccaacaccgaacggctttgcagagatactattatccggttaacaccagaatatataataccagtatgacactcgcattataacatccttggtgcaaccggtcaatgggtgttatttttatgcccttttttacgtacatttaacaaggagatgatacaattgacgctagatcccaatggtaagtattatatgtacttacgcaagtcacgtgaagatgtagaagcagaggcacacggagaaggcgagactttagctagacatgagaaccgtttgaaggagctcgctaaccatttaggaatttcaatttctaaagtttatcgcgaggttgtgtccggagaaactattgccgcaaggccagaaatgatgcgtttgcttaccgatattgaaaacgatcaaccgaatggtgttctagtcgtagaactggaacgtttggctcgtggagatacaagggaccaggggctcattatggaaactttcaaatatggcaatacaaagataattactccgatgaaaaccttcgatcccaacaatgagtttgatgaggagtatgctgaatttggacttttcatgagccggcgcgaatataaaacaattcgtaggcgattacgagatggaaaatacaacactgccaaggaagggaaatggccttggggaaaagcaccatttgggtatgaacgctataaactaaagggacaaaaaggctatagccttaaaatagttcccgaagaagcagaaattgtgcgtttgatttatgctatgtatactgcaggaactccagaaacctataataaacctatcagtgttactgctatcggtaaaacactggacaaaatgtttattaagcctaggtatagtgagacatgggctcataacgtcatacgtgatatcttgcttaatcgaacatatattggagaaataccagctggcagacgcaaaatagtcaaggtcatgactaatggcactgttaaaaattctacgccaatcaacaaagattgtgattattttcctgcattacatgaacctatcattgataaagaaacctttgatctggcacaaaaagtattcaattctcgatctaaaccccctgtttggctaagtggaacaatcaaaaatcctcttgctggacttctaaaatgccaaggctgtgggtatacaatgattcgccgtccagttagtggaagaattaaacaagaattgttcttatgtaagaaatgcgatatgcccggagccgctgttgatgatgtaattgataaattaatgttagcattgagatcttggcttgctgattatcgcatctccatttcctctcctcaactttcagttgttggaatagctattacgcagaccaaaataaatgagactatggattttatagataagcacaaaaaacggttagacaaggcatatgaggcatttgagacaggggtctatgatgcagatacactgaagaatagggtggaaaaaataagagaggaaataaattccgcacaaaatgcactagatgaactacttaaacaacaaaaacgccaagaggattttgagaaaaaaagaacgttgctaataccgaaaatagagtttttactagataattttaatacgttaacaccagaagaacaaaatactttattaaaggaggtcttggaaaaggttgaatattcaaaagaaaagcgcggaaccaagaaagaaatcccagattttaaccttaaaatttatccgaaaatttagtgtgtcaaatactgataccattttagcatatactcacaaatgcgcatagatacacctccttagtgtattctatgcgcacacatcccgtatgacacggttctaccactgattttcccacatggactgagaaaaggcttcctcaacgcctccaaaggagttatgggaaaactgccccttaagatccagataatactctgtcatggtagcatagatataagggaatatccaaagaaaaccgatcccaagggaacagtatcccaggatgatcatgccggaaaagcttatacaaagataaaaaaacctgcctttatttcctttcatcatatgtgcgctttccttaaggcacctccataccctctgatccggagattcaatgaggatatacatggactgggataagcacagcattgtaaagatgcttccaatgagcagaaacagatacgtaagcaccagcaataccaccatgaccggtatgaaatcagtgatcaatgcaacagcaagcaccacgaaatacgggatagcccatataaatccaattaaaacatttaataaataaagtccaatgaatttatgcggtttattctgaaatgcaaaaagcagatcagacagcctggccttatggccggtactcatattcagataaatcttaagggttccgggtattaaaaggctgtatacggaaaggatcaccagaaaggataaataaatccctgccctcaaagccatatttcccgcaaatgtgctgtttattccggcggaaaaaggatctttcaccagccccatggaaaatgatgtcaatacatacaccagggaaatgaccacaagaactgcccctgcaagaaattgggcaccaatgcacaggccgtatccgccttttaagttccgccttgcacgctttttaagttctgatgatgaagtcttcacgaaaacacacctcctaaccccaaatcactcatagccgaaataccgataaatacgattataaccaatacaaccagcacaatggcaatagatgaagtgacaaggcctgcctttgcatagccttccagcttttcttccgtcctggaaagcagggcaaacaggattccaaggcttccaaaaatcaagcctccgtaacagcagcaggaggttataattcccaggatccccatgaccagggatgcaagggccatattgctctgggccgctttctcaggctgctcataaacaacctcctgattcccttcctgcctgtcctgccaggaattctcttgattatcctgatccatttttatcatctccctttttctcataatattgcaatacagcttctgataaaagtcgcatgccttttgcgccatccagccgattgttggaatatgaattttattccagcaatatggcaattatacaatattttccattaactgtaaaacaaatcttttatctgttacaaacctgcaaaagaaatagtccaggtctcctgctttccactgcctcccttttgcgtttccccaggcaatccctcgccgggccccacgtttctttttcatattacctctccgatttctcttcatacgcttttatatccttagcttctatccatgtcacgtcaattaagtattccttcccgatctctctcccttccactgcgtccgccagtttgtccaccagtgtcctgcctatcacctggcagttctggtccacgatgcctgtaatcaggccctcatccacaccggctgccagagtaggggaataatcgaatccatagtggtacagagttccctgcagattctggaatttgatagcttccatggttccggtaatgacagactctgttcccagagtgaacaccgcctttaagtcaggatatgatatgatctgtgtctccaattgctcttttgccctggatacgcttaggtcgtttataatccaggtacaccaggtaaactgggcggcctcctgctccatcgcctggttaaaaccgtccttcagccccctgtaacgctcggtcatgttctgagcggaaccactgtaggtaacggccgtcagcctcccccggtaattccccgggcttttaagtcttcggctccccgtcttcccagttccattccggcttcataattattggttccgatatatgccagccggttgtttaaagtcctgatgtccgtatcataggtgactactttgattccggcagccattgcctccgccgcttttatatcaaacatctccggttctaaggctgccatagcaatgccgtctgccttctgatcgatcgcctcctggaccatttcaatcagcttctggggccgtgaggaatccccaggcagcccggcttttatgatcagagaacatccccgcttctttgcctgctcctgcgcgctttgtatcagcggcttccaataaggtccttcttcattcaatgcaatcaaatacagagtcttcccttcctgccgtttaaaagcgtcggcgggctgcctcccgcatccggataccaaaaggcataccgccattccgattaccccaattttaaacattctcatgccgattcttccctcttcttccgaaaatagtccatcacgatcgccgccagaatcataagccctgtaacagcctgctgcccgtaagtatttaaaccggccgcattcataccgtttttaaacacttctataataagcagccccagtaccgcacgaacgatgcctcctgcccctccttcaaaccggatcccgccgataatcacagcagcgatggcatatgcttccagccccatagcctcactggaggcgcccacgttcaagtaggacatcaggatgattcccgcaatccccgcaaaggccccttcaataaagtagaccttcagaaggtgccgttttacctggatgccggccagactgctggccttcttactggagcctacggcatagcagtatcggccgaatatggtacatttcataacaaggacaactgccactgccagaatcaggaagataagaaagttggaatagaggatattgcccagcagatgggtgttggaaatgtggtagaaccagcctggcaggccgctgatcaaaatgccccctgtgaacatctgggtcagcccacggatcatataattgcttcctacggtcactataaacggcttaagctcaaaccgtgtaatcagaaacccgttgagaagtccccatgcaccgccgcagaggattccaagagccaggcatgctgccggatgcattccccgcaccgccagatacgcagccgccgtccctgcacaggccataatggccccgcaggataagtcaattccgccagagatcatgagcattgccacccccagcgtggcaattcccaaaataggcatggaacgcaggaagctggcaaggttccctctggtggcaaataccggtaacatataagagaacacagccaccaggaagagtaaaagtccaatcatccagtattcagccattttttctttccagactatctttttcctcatcccaagctctctcctctttccgttattcccggctgcttatttacatattatcacatctaattttaacagaacaacggatatttatcaatgcagcatatgtttcagaagattcagataaggctggttcttaacgcagttttccagcttgaagcctccggcaatacgctctaagtcatcctcactgtatccggcaaaacgcctggcgtaagccggctgcagcatagcgcccgcatagccgttaagcaccccgtaattcatcacaaacgcattggaagctttgtcaatcctggtttctcccatcacatccaggatataatcggcaagcgcgcgggatttctttctgccctccgccgcccctgcataatctgcgacaaaattctcagctcccaggatgcgtttttgttcctggaccggctggataatcttcatatattcgctttccggatctaagaatacccatcccataatccccggatccttataggtccaggtggtccagtggactccatacgtgttgtaaatatccagctgatcctccatagatgccaggcggtatggaagctcctccaaaaaaccatgatactgagaaccgaactcccctacccacagaggtacatggtgttttaaggcaaactgtgtcccctggtggttaaggaactcagccctctgcttattcttatcccagtacaccccgccataatatcccgggtacgtccccggcccatatcccggaggtatatagttatggctgctgtataccagattatcctcaaaaggcttctcaagcccttcaaaattcctggaataattatccccctccagaaacaggatgtgctttttatcaattctacgaaccgcatctgctatctcccggtacagtttgttgattgccttccagtccgactgatagaactcgtaaaagtcataggcatgttcgccggtgggcgttcctgtggatggctcattcatcaggtcgtagcctgccaccgcacttctgcccttatacctttgtgcaatcacttcccaaagcgcaatgatccgttcctgaaaatggcggaagctccagagaagagccgctccccgttcgttatcactgtgccagtggcagttctgccagccggacaaagcatgcatatccaggattacgtagaccctctggcgttcgcaggcatccagtacggcatccagccgtttaaatccctcttccttatatataaagggattctggtcatcctcaaaatgccggtaactcaaaggaattcggatgcagttggccccggtttcccggatcagccggatatcctcctcagccagaaaattgtcaaggatggtctcaaagaacaattctgcctttcctgcaccaagtgccttggccatctctcttttcatcccgctctcagtacccggatatccgttgataaaatcctccatgttcatccagccccccacgcaggttccgcgaaggtatacaggatttccagattcacccacgattacaccatttcttacctgtaataaatccattttatctctccttcttcagctttctttcacacagtccctcttataactccacccgggtttttaaaggtttagcccccataagcagacagctcctactgtcaggctggcttccgcctgcatatatatcaaaccggtatccatccagcttacggttcccgtcctggtccaccacgcagaaagcaagacctggaagagaaaagcttaccttcctctcctgtccctttgcaagactcaccctggcaaaggcatacagagaatggttcctcactgctagagaagaatccaggttcttcacatacacctgaaccacctcctcgccatctgccggcccttcattcctgaccttcacggatacggacacactgccgccatctgcagggacgcactctaaatccctgtaccggaagctggaataggaaaggccgaatccaaagggataaagggcttcttctttcatataccggtaggtccggtttttcatgctgtagtcctcatagggaggaagctccttctcagaccgataaaaggtgactggaagcctgcctgatgggctggtctccccaaataggattctggctacggccgttccgccttcagcaccgggataccacgcctgcaggattgccttcacacattccgcctggtccagccacgctaagtccattgcgcttccagacatatttatcaccaccagcggtacaccagtctctatgagtgccgtcagcaggcggcgctgggattcaggaagagccagtgagggcttatccgccatactgaccgtctcatcaaaacggttacccagatcctgctgttccccctcataccgctcatccagtcccacgcatacaatggccagccctgcttcaagagctgcagccaccgcctcgcttatgcggtctcccggcagtgccagccgttctacacggtccttcatggtatggcagccttccgagtaaaagattctagtatcctcatcaagaaaattttctatcccatccagtaccgttacataacggggtgctgtgccgtggtaattggcgatgagcggccagcggctgtccgcatttggcccgatgacagccaccctcttaagcttcttatcaagtggtagaatcccgtcgttctttaagagaaccatggatttttccgctgcgcggatggccagctttctatgttttttgcatcccaccgtctcataaggaatctggttgtaggggcagtcctcatcaaacagtcccagacgtattctggtgcgcattgcatggaccgctgcctctgtaatctcctcctctgtcaccaggccctgttcataggaacttaaaatatgcaggtaagtatttccgcagttgatgtcgcagccatttctcagggccatggccgcggactgggcggcagtatccgtcacatgatggttttcatggaaatccttgatggcccagcaatccgacacaaaatatccgtcaaacttccacttctctttcagaatatcctgtatcagagttttgctgccgcagcatggctctccgttggtcctgttatacgctcccataaccccttccaccttaccctcggagacgcaggcttcaaaggccggcagataggtttcccacagatcctttttgctgactctggcatcaaaggtatggcgctgttcctccggtccgctgtgtaccgcaaagtgcttggcacaggctgctgccagtaagtattcaccctctccctggattccctgtatgaatcccacgcccagtctgccggaaaggtatggatcttctccatacgtctcatgacctcttccccatctgggatcacggaagatattcacattgggagaccaaagggtcagccctttatagatatcccggtcttccagggccgaataagcattgtactttgcccttgcttccatgcccgccgcagtgccgatctccttcatcatctcctcgtcaaatatggccgccataccgatggcctggggaaacatggttgcagtccccgcccttgccacaccgtgaagcgattcattccaccagtggtatctggggatccccagccttttgactgccggggcatcaaatcttagctgggaggccttctcttccagggtcatctggccgactaactccctggccctctcttcaaaatacatatcaaatcctctcctctcttacgatctatcccattcgttctgttccttatatatgtcccttccaggctcactcagcctttaaccgctccctgggtcagtccgttaactaccttttcctgtgcaaagaagtacaaaaggatgaccggaagcgatccgatcaggatagcggtaagcactgccggtatattcacagactgcatgccgtagaattcccggatccctaagggcagggtcttctttcctgtgctgttgatcagcacgttggcattaatgaattcattccagatgttcaaaaatgtatacaccacgattgtggagatagccggaccagacagcggaagtatgatattcttaaaggttcccacaatgctgcagccgtcaatgatggccgcttcctccagctcctttggtatctcccggaaaaactgagtcaatatgaaaacggcaatgggaatgttataactgacataaggccccaccaggccggttaaagtatccgtcagaccgatgctgcttaaaagcgtgaatgtggggatcagtgtcgtatgtaccgggatcatcattcctgcgataatggcaaagtaaagcagatttctccctctgtatttaagcctcgcaaaggtgaaggaaatcatggacgatacgaccacaatgatgaaaacactgactcccgacaccataacgctgtttaggaagtaccggagaaaatccggtttcagaaccaactggtaatttccgaaaaacggctctttgggcagtctccagatattggttaagtattcccccatgcctttaaaactgttgatgaccagaaacacaaagggaaatcctgtaatcagtgcaataacgatgctgattgcatagagaatggcattctttatttttctttttaacaacacgcccatattatgccgcctccttatctctcgtaatataaaggaacaaacatgctatggcaaaacacagaatgaacatgctggcagcaatggcgctggcatatcccatgcggaattccgtaaaccctttcttgtacatgtaggtggccatcagctctgttgctctgttgggcgcgccgcccatcatgacatagaataagtcaaagtattttaaagaccccaccagctgcagaaccgctgctgagcgaagggtcggtacaagcagcggaagggtgattttccagaaacactgcttcccatttgccccgtcgatcctggccgcctcgtaaatgtccgtcgggatattggtcagtcccgcctttaatataatcatatagaagggaatgaactgccagcatatgacgaacagaatggaaggcatggatgatctcccttccagaaaagcaatgctttttaagcccaacttctgcataagactggctatcaggccaaaatagggatcataaaacagaatccacataataccggttgcaaccgtggacagaagcatcggcataaaaaacaccgtacggaaaaaccttgttcccttaagctcctgattgatcagcagggctaagagaagggctccggggagctggacagccacggagacaatgaccaggattacgttgttcatcatagcattccagaacaaagaatctccgaacagctcgatgtaattcccaaatcctgcaaaagtcctgttggcgctgatccccttccagtccataaagctgtagatgaatgtcctgacgattcccactacgttaaatgttccgtaaaacagcagggccgggagcacgaacagcgttatgatcccaatatgtttatttcgtttgctcatataatcactccttctcacagaggacgatccggaatgagggcgttgcaacatgcattctgccatgcaacaccctctcctaccatgtcatgtattatttcttaaccagatccttctgtgccagcgcttccatgtcagcggccgcctgctctggcgtggtggtgagtccaaagaggtcgtaggtggtctgcttatgtaagtttccaagctctgtcggcaggaactggtcgtagaagttctgcatataggaggcatgaaccagaagctcctccatctgctgcagcttgctgtccttgatttccacaccctttattccggtaaggatgcctgcggtatcagacatatcctgggcatattcctgatctgtcaggacttttatcagttccatggcttctttgggatttttacaggaagctgagatggaatatccgtttccgcctcctaagatctcgtctgccttcccttttccgccttctattaccgggtaattgaacaaccccagattattttcgtagaaatccggtttttcagacttacagttggagacgaaactgttggtctgtacaatgtgagctgcctgaccgctgtaaaacagcattctggatcctccggtatcataattgataccattgaggccttcggggtaatatcctttcttcacccaatcctggatcctctgtccggctttaataaagctctcgtcctcaaacgttgcattgccggtacggttataggcatcaaggaatgtctgggagcctccctctctaagggacagccatataaaggtaagcgcacccggccactggctggaattgccctcagcaaagggaatgatgccatgttccttaataacttcacaattggcctcaagctcttctaccgtctccggaaccttaagtcccagctccttataaatctcggtattatagtacacaggagccgcccctgcccggaagggcactgcccagtatttcccctcaagctcgaaaagagacagggctgattcgtggtagatgtcagagatttttctcacgtcctcatcaatatcaagcacctttccctcttccacaaaggactggagccatccgccgccccaggagatgaatatatccggctcctgtccggctgccatggcggtggtaagcttggtcttataagggtcgttctccattggcacctgttccactttcacattgggatggcttgcctcaaatctttcaatacaacgtttcactacctcctgccgtttggcgtcattttcaatatgccacagggtaagggtgatattctccccggtctttgcctcccctccctggctctccgctcccccatcggattcctttgaagctgtcgtttcacccgctgctgcgccgctttgggaagttccgccgcatcctgcaagggctcctgctgccatagccgccgccaatatacatgcaagaatctgtttgttcatactccttctcctttctcgatcaacctgttcacaggtgtttgatggaacttatcataagattctttcggtcttttttcaatgcaccgttttttagaatatgtgtaatatttctatttttgtatgattacagcatattttttatgcatttttactaattccaccatttacactgccattttggtatgctatattaagagaacaaaaatcatgttctcttaatcagatttacggcggtaacgcatccgccttttagcagaagaaaatgcaacttctgctaaacaatattaatgacaaattaataagagaaagaaggggtcctgtgataagtgaaagaatgaaggtgctcatagctgacgatgaattcctgatctgcgagctgatcaaaaagatgatcctatgggatgagctgcagctggaatttgccggctgcgcccacaacggtcaggagctgtttgggcagattcaggaaatacgccctgccatcgtgattacggacatcagcatgcctgttatggacggcattgagctgatccgccagacacgatatttaaatattccctgccgcttcatcattgtaagcggctataaacagtttgaatacgcccacaacgccttgaaatattcggttgatgactatattttaaaacccatcaatgaaaacgaactgaaccaggcccttaagaaaatcatggaagaattgaatagccatcagtcccaggctgcaggcgaggttatgcctgccatccacacagagcatcccggcagatcctttttcctaaagcgtattatatgggaaatccaggaccctgctgtccctctggagcaggtcatcggtgaatatggcatagactttaaaccaggactgttctgtatcctctgcctcaagctggactttgtcaaccagagtgcggataatctggacaatatcggttctttaaacaaaaagctgatctccatgttccacgaggaatttgaaggcttctgtttccaggttctttcctgtatggaaggcaccgcgatctatctcggcatcaattatccccggcaggaggccgtatccttttctgaccatcttaaggaattttaccagaaggcctgtaatctcctggacttatttgccggacttaagataactgtgggtgtcggggattcctatgataagatctcttccttcggacagtccaataaggacgcaatggatgctgcctattaccgcatactgtcgggctgcggccagatcctgtactggaagaagctgcctccggttccatatcttacagaagtggaaaaaggtttatatttacagcaattcaaaaaggccattgaatccgtaaatatcacggatttcatggctacattaaatcagttgtttttcaggccaaagaacctttttccactgtttgatatcattgacatgctgggggagatatgccgggtgcttgtacgcatggacttatctttggaccaggaagagctgccgcttgactacttatccggccagattcactacgccatagaaaacgcattgtccttagattccttaaaggctgccgtatcggaacctgtgtcctacatatttgaaaatatccacaaggccgtccaggctcagaatacccgccccatccgtatggtacttaaatacattgaagaacattataaggatccgatccggctggaggatgcagcgctattagtaaccttaaatccggcctacctttccaatatctttaaaaaggagaccggtgagaatttcgtggactatttaaattcataccggatcggtcaggccagagagctcttaaagggctctaatttgtccatcaatgagatcgcatattccacaggctttcaggatgcccgttatttcagcaagctatttaaaaaatacgttggcatcacgccgaaagattaccgaaaaatatacagttgacatgcaaagggaaagaaagaatatgaagctcttaacagaaaagaaattacaaaagctcttagaggaacacagccagaaggccgtccgggataatgcgcgttactatgaaaatgaaatcttaaagaaacagaccgaactcctgaccctgcaaaatcagataaacccgcattttctgtataatgccctggaatgcatccgcgcccaggccgtactaagcgatatgagggagatagcggatattacctatgccctgtctaacttcttccgctacagcatcagcacgaaaagcgactttgccactttgaacgatgaaataaatgtaatcagcaattatatgaagatccagcaataccgcttccgtgacaggttctgtctgaacgtggatctgccggatgcctggaacagcattatggatgcagtgattccaaagctaaccttgcagcccattgtggaaaacagcattgtacatgcctttacggaatccgcagaccaaggggtcatcaccatagaagttattccttccaaaaagcatattaatatccgcatatctgataacggaaaagggatagatcccaattcccttaagatgctgaaccgttccctggatcaggagtactatgtcccaccaaattacggcaaaaggagcaccggcattgctctgtggaacgtaaaccggcggctgaagctggtcttcggagacgattacgggctccatgtttccagcacacctgccctgggaactgatgtggagcttcacatcccctatatctccgtgaattctgatgacttttctcaaaacggaggaaatacctatgcctgaggaactgtaccggatacaggatttatgtttgcgcaaagacaataccatgcttttagaccatctgactatgtatcagtataagggagaaatcattggactcatgggacttcatgactccggaaaaacccttctttcccttatcctgtccggtcaggagttaccggacagcggcagattctactatgaggagtccccggtttcccatcaggaactggcatcccacgttgccttggtacaaaagcacagttccctgatcccctctctttcagtggcggaaaatgtgttcatcatccggcggcataagaagaatgcctttctcatgcaccgaaagcttatcctccatgaggcgcagaattacatgagggaaatgaagcttgcaattcctccccaggaacagattggccatcttacaaggtcagagcaatgtctggtggagataatgaaggcttacatacttggagccaggctgatcatcctggatgacattcctctgaccttttttcaggacccgcaattcacaaggatgtaccagtatctgaaaacaaaaaatgtttcctttcttataacatcctgtgacatataccagcttcagatcttctcagaccgcatttactttatggacgaccaccgcatggtgaagtggatatacaatgaaaaaaggaataccattgatatttcaaagctgtacagccgtccctggcttacacagggtcttcttcccacgcctcccgggtcgtggcaatgaaagcggatgggctctgttacggttcattgaaggacatatgctttgaacttcatgagggcgggatcgttgccatctttgacttattccggaacgcctcatcccaactgctggccttcctatcccatccccgggatctgacatccggctccatctgcgtatatgggaaaccagtcagaggggagaattgctcttcctttgtatttgccggatttgatttagaggactgcatcttcgaaacactgtccaccagagataatatatgcattggcagctacaggaagctggccggtcccctgggcatcttaaaacacgccagaatgcaatatgtggaacagactttcctaaaagaatatgaaggagaggggtttgtaccccgctcctcctgcaggaacctgcctaaaaaggaaaaactggccatgtacttataccggtttgagtttctgcgaaagaaaatcatcttctgcatttatccggaaaaatatgttgattatgataccttatatatgctgaagaaatccctgcagcgcatcgccagaagagggaacgccgtgtgcatcattacatgtgattttgaaaaagtatatcccctggcagagcgccatctgatcctgtcgttgaattctatacaggagtattcaggctgagacaaggaataagactgctatacagggattccttccagcctcctctgtcttaccctaatgacacacatacattttcaggcgttccggccaggtatttctccacattgccaaaggtgatctccgcccttcgcaccattgattcctcagataaaaacgcctgatggggagtaagcagggtattcttcgcatgaagaagcggataatccttagccagcggcggttctccgtcgtaaacgtcaatacaggcatagcccagccggtccccgtttaaggcctcagccagggcattgttatccacaatcggtcccctggcgcaattgatcaatactgcatcccgcttcatgagtgccagacgttcttcatttataaaacctctggtattctcattaaggggaagatgcaaagatacaagatcactgcgagacagcacctcctccaaagactgatatacaatccccgaatgctcacccatttccggtgaggcaggatcataggcaatcacctttgctccaaaagcctgaaacagcttcgccgttaccagaccgatccgcccaactccaacgattcccacagttctgccgcagatctcctttccgccgatgcccgcactggtaccgccggcccgaagctgctggtcagcctttcgcaggttccgtaaagcagcgacagccatgccgatcaccagctccgctaccgtctgattggaatatcctgccgcattgcaaaccgtcaccccctgctcccggcatgcctgtacccccacatggtcaatgccggtaaaggctactgcaatcatttttagctcctgtaccgcccggaccaccgtatctgaatagggatggttggcgattattacgatatcacttcctttgctcctctcaatcaacttctcctcactggccgctaccgtatcatagctggaaaaatcatgtccctgggcggcaagcttctctgcatatgttccaatcagagctttgggaacacttaaaggttctgctaacgttatcttcatctgatctgatcctcctgtcccagatacactccctgggaaattaatgttgttctcagtttcattacatccagtgctttgggcagacagccttcccggacacaaagggcggcggcagttccggcagcctgcccctgagccatgcaggacaccgtattgcgggtagacatatgcgcctcccaggtactggtaatgcatctgcctgccaccagaattccctgtaatttcaccggcagcagcgcccggtacggcacgccgtagcagccgccgtctttaatgacaatccgcggcgcgcaatcatgaaagccgtatagatacacctcatcctcaaaccgccgtccattcacaatttcatccagagacatatcatgctcacaggacacaattctggtcagccggataccgatgctggccggcgtccagctcacataggctttttcaaaccccggaatatactgcttaagcatcgccgccaactgcatgatctgatggcgcagagtaatctctgccgccgaatattcctccgaattggtggtgtccacattttttaaattggcgctgttgatgtaagtaaagctgttttcatgaagggaaaaacccaacggtccccacatgccttccttatccataaattccgtaaattccggcacctggtttaactggaagcccagacgaatcacgtggtctgtttcgctccccttatccccttcaatcagctgggtgatcaaattcttttccttcagatagtccaccaatcgggtcatatcaacatcattcatcccgaaaggcattcccactgaagtggtatcctgacgtttcacataatccgctcccgccaatgcggcaacatccgcatccccggtggcatcaatcacgactcctgccctgattgcctctctccctgactttccttctgtcacaatgccggtcacccgggccccgtccattaatgctcctacaatcatggtatgtaaaagtactgttactccggcctcttcaagcatggcaaatgccacatccttaaacagctcccagtccacgatcgtgatcacggaatcatagctgccgcccttgtcctgttctaaatggccgggggacccaccggctgccatcatccgttcaataatctcctgaggaatcccctgaaccacctgctgcttcggagcctccgggaaagccttataaagattgtaaaagctgtgaagcggtcctgccccgtttaccagggtaccgcccacataaccaaaccgttccaccagaatcgtctttgcaccgtttctggccgcagcaagagccgccgcgaaaccggctgtaccgccgccgcacaccacagtatcacaggtgtatcgtaccggcgtcctgatctgttccacaataaaatcgcctgccatcattccctctctttccgttccggactctgataccacagaactgccggattttcatcataaactgattttgcagttatccttccctgcagctgtccggagagaatccggatccgcttttccattccgggaagcaaatcaaaataattatcctcaaacagccagccaaaagccgccccgccatctcctgccgtaacctccacacacctggcaaaggcttcacagcaaaccaaaagcaaatcaccttcctggatgagggacaaacccgttttcactggatattccatatggcgctcgatctcaaaaacatccagtgaggttcctaaaacctcccctgaatctgatacagccctggcatacaccgcatgcctttttaaaaactgtccgaaaggcttgagggtacagacaggccgggattcgtccggaaccaccgaaaatgcttgctcaaaggatcggatcatgcaattcttctgaatgtcaaagagcgacacctccaaaatcccctgtttcacctccggagtatcattggtaatccacaaatagccctggtccccaaactcacaggatagaaaaaacggctcatagcagcgtttcaattcataataaggatagtatggctcctgaaaataatccaccactccgtaagaaataatattgctgttattattgaacttccagagcagatgcccgcctgtccgccgcctgtccatcggatggtctccgctgtagccccggcggaaccgccccacttgttcccggatatattccccgtgtgccgcgccaagattatacaccagctcctccggggaaagagcgtcataataatgctccacaggccccagctttaagaagccctggttggtattatgccggctccaggtttccggccattgtaacattgttttccgtgttacccggccgctataaccatcaggccaaagctcctcctccgtcatcatgcgtctcatggatttgattgccggtgccgaaacccggcagttctcacttaagaacaccggatattcccgccccggaacaaaccacagatgggtatagccatgagtgtcaccctcttccgggtcattggcccaccggcctccggacggggaagaaaggtgataataccgttttggatcaaggcttttgcacacctttgcaaaaacctggtcaaaaatcacgctccccagacattcctcgccgggataaccatagtcccggcataacagagtttcattgccgccgcaccagagcaggatacagggatgggatttcagccgttttaccagctgcattgcttcctcccggcacagcgcaagataatgaggctcttccgaatacagggaacagcacaaataaaaatcctgccagatcagtatccccctgcggtcacactcctcataaaacgcctccggaagcttttctccctctccccagacccgcagagcattgaaattgccaagctctgccagatcaagaagccggttcatcacctccgggcgatagcaattactcatggtatccggatgaaccaggtttgctccccacagttttaaaggcctgccatttaccgtaaaattcatctctgccccgccggttatccggcggaatccgacagatttaatcaggctttcccccgggctcccgatacagcacagctctaccttatataaataaggtgtcccgtgggttcgcggccaccaaagctgcgggcgttccacacgcagctctgcccttacccggttatgttcaaccggtatttccagacctgcagccagccgtccatcctcatccagcacctggacagaaaccagcccctgcactccatcgcccagaaacactccgtcgaccagcactctcccgctgccgtcctcctccaggatggtgtcaaccaaaacctctttaaaagaaggggcaaaaacctgctttaatgccaccgttccatagattccgcatcggatcaaaaacggagctggaccacaatactcgtgaaatcctgaacggaacacccgaaatgcagagttcgccccaacccgtccctgatacttcggggcagtactgcttcatccatccggtgctttgccgaatgaaaatgaatcagcagcgtattccgttccagaagcacctgggacaccggaatctgatactccaaaaaaacgtcctcacattgcctcaccaacacgccatttacataaatatcggcaaaggtatcgattccttccagcaagagccaggactccacccctgtctcagccgaaaacccgcaccggtaaacccagtcatagtcatcaatccacaaatcctcgtttattcccgtaagattgggattttttatttccccatatgccagcagcacatcatgaacctgagccggaaagtcagaaatctcatagatcctgtctcttccagttcccggggtctcaaacccattctcaaggtcctcatagctgaaccctctccccgccggaaaccgtttcatctgccacccggcacaaatgatctgtaagctcatatcagtccccctgtcccagccttaaaacacaaatcctctggtctgtttcaaccgctccatcaccgcttcatcaagcacaatgccgctgccggagatattggaaagtgcctgttcccgggttttcgctcccggtatcacacaactgatacctggataattcagattatatgccagagaaagctgtaccatatttaagccggtttcagccatacacgcccggatgatctccatatctggctccacctctttaaacctctcaccggtccaaaagcccttccggttatccccttccggaaagccggttccggcagcatacttcccggtcagaattccgctggccaggggctggctggtcagcacagcaattcccctttccctggcaatctccaccaccttaagattcgatttgttcagaatattaaaggggcattccaaaacctccatgacccgctcctcatcctgggaaaatgcatgaagcgtgtcctttgctccccacatggcaagtcctgcaaaccggacctttcctgattgcttcatctcctttagcgtatcccagatcaggcccttttcctgccaggcggcatccggcacatggagaagataaacgtcaacatactctgtctgaagccgcctcagactctcttccagacaggcaaacagatactcccgttcaaaattcttacttctttcctgaacccggaaattagttccgccttttgtaacaatcacggcctcctgccgtttcccctttaaaaattttcccagcaaaatctcactgtgcccatcgccgtaagcatcacaggtatcaaaaaggcgcacaccctggtcccaggagatttccaacgcctcccaggccttctcatcatccgctgtggatccccagccttttccgccgatggcccatgcgccaaagccgacctccggcacgtacagtcctgtattgccaagcttccttgatttcattatggttccctctttctattaatcttcgaatatcttcagctcccgcaactgcctgatgacatccttcatccgcttttttccaaacttttttaatatgtgattgacctgtgagcgaatcgtagtttcctgcacaaaacgcagctcagcgatatttctgtaggtaagcccaccgtatatcattttcaaaatctcatattccgttgtattaatcagaagcatcacctgaaaggtttcctttaaacggatctggttttcctgcacctgccggtatccgtcaatcagcttcctggcaacctccggcctgacaagcagcttattgtcaatgacatcatgaatggatttgacaatcttctccacaggacttaccttaatgatatagtctgccgcaccggccagataagcccggaaaataaactcctcatcctcatgaacggtcagggcaatacactttacattgggaaacagctcctgaatctttgcaatcgcagaaatcccggcaatcctggtttccatctgtatatccatcagcaccacatccggcaaaagctcctcagtcagcttgacggcttcccttccggttcccacaacaccgacaatatcaatgtctccggacaaagccgctattttttcagccagatggttgcggatttcctccatatcatcggcaatgataattctgatcttctccatgttattccctccctgatcacggctgttttgccgggtcgtttttgcttactggcagcatcaccagcactgatgtataaacgccttccctgctgtcaagcttcacctgccccagatgcgctttcaccactttatatacatagggaagccccaggccccagttcatcttcccctgcttgccggaatagtggggggtaaatatcctgttacggtttctgggcttgataccggttccgttatccgtaatcgcaattaccagccagtgaaacaggaaaaaaatctgcacggtaatctttccttcttcctttcctgactgctcaattgcctccaccgcattgtaaaaaatatttaccagcgccttacataagtgatacctgtcatacattccgctgattccctcaaaacttgtcttatcccactctatcctgatattctccggaaccgtcacctcggccagggcttcatcaataatgctgacaatgcagttatgaaggtaatggtacttgacctcctttaacttatccagcatctctgtagtccgggccagggattcatcaatcagcagtttcattctcccgatctccggaacttcctccttctgaggcaccttggcgtcaatcttaccggtcagaatctgcaaggaaaacagtaaatttttttgggaatgaagggtttcacccagcatcccgttcataacaatcagattcttttgaatcttccgttccacaaacagggtggcggagatatccatacgaaagctgagcagaatagacatgcagaccgccagaacgatcaataccaccgatggggaagtcagatacaccttggaaatcctggcctggacattttcaaaaatccaaaaaccgctgcggatgaccttaccaacggatacactgaatggccctacgtaaaaaaagcggtaaaacagggaggccaccaggagcagccccatggataacaaaaaaatacgtttccgcaaaaacagcacggtcgtctccgccacataccgaaggagcagaaaaaccggccgcagcagcaaataaagaacactcagcttaacgatcaggttcaccgcctcaaagacgtaatacaccagctgcggtctggccgaagtgtgataatagatgtacatgtttgtagatgttatgggatcatacaacagcagggacaaaaacggaatcaaaaacagcaggacatggccccgtatcttcacccggctttttttctgctctctgtagcctctcagcccccgataaaattcgtaattaaaaattgtctctgccaataaaaacagggcgattcctaaattcatcagccggatattatagacaatcggcagggccatacggtctgtaatcgtcctgtaaatatagtaatccagacggtaataaatactgctgtcataataacttgcatagcttgcaaacatattgatatgcaggataatggaaaaaaacgcaatgatcactcctgctgccatcagcacaaataaataagagtatctgcttttccggtcaaacacaagcaaaataatcgaaaagatcaacagcaagccaatggtataaaacataaatcgccctcacttatcctttgacagaaccttccgtcagtcctgaaataaaatatttgtttaagaataagtatataataaacatgggaagaattgaaatactaattcctgcaagcattaaattccaggaggaaacagcttctccgctggattttaagctgactactccgactaccagcggccatttttccttggctgatatggtaaatacatagggaagcagataatcgctccaggctgtccggaaagccatcagccctgtggtcgccaccagcggcttgcacagcgggaaaataatccggcaaaaaatcccgaagaaactgcatccatcgatctgcgccgcttcatctatctccctggaaatctggcggacaaaccctgtggcaacaaaaacctgagttgcattcatcccaaaaaccctgatgataatcggcccccaaagcgttccattcagcccaaacagcttggcaaggctcagctggggatacagggacaaggttccaatagaaacaaacatggagcacagcagcatggcgttaaccagccgggagaatcttgtcgtccccctggcaaacacataaccggccaaaatcgaggtaaggacacaacctgccaccactgccactgtatagaaaatactgttaaaggtcaattttccaaagttagccagattccatgcctgtacataattttccagatgccattcccggggaataatccggactccgccaaccagtatctcctggttggatttaaaagacgacagcaaaatatagacgaccgggaagacggcaaacagcgtaaccacagccagaaaaccgtacagaataatcctcagtatgtgtttcgatacctttttcatcgctttcctcctccctattcatcaaccgactgcattttctctgataccttcaaatagataagcgtcacgatccccaaaataattgccgtgataaccgccattgccgaagcatagccaaactgcacttcttttgaagagctttcgccgtaagagaagaagtatttgaaaatatacgtcattactacctctgtggaaccgccgggggcaccgttggtgagaaccagaattaagtccgtcatcttcatcgttcccaaaacactcatcatcagtaccagttgaagaataggcgctaccatgggcacggtaatgtgaaaaaactgctgaatctcgtcagctccgtcaatagacgcacattcatataaggatttggaaatattctgcagacccatgagaaagtaaatcatatttaaaccaaatgttgtccacagggacaccaggatgatcacaaacatggcatgccccttatcactgaaccagctgatattccgcgatataaaaccaatctcccgaagagcggcattgataatcccattatacgcactgaaaaggatggagaagatcaatcccaccaccgcgatactgaacaccgaaggcaggaagaacaccacccgaaaaaacgagctgccatttatcttattattcagtaaaactgccagcagcagggaaaggggaatttcgatcagcatcttaataccggcaatcagaaaggtgttttttaatgaatcccagtaggcgggatccctggcaaatgcccggacaaagttgtccaggccgataaaaaccggatcgctgtagccattgtatttaaaaaatgaccagcgcagcacccagataatgggatatacggaaaacatcaaaaacccgattgtcatgggcgtgatcatgagtatctcctggattttgttccctttgtgaagtttattactcctttttaatattctgctcataagcacctctttaaaaaagcacttccaaatagatatgcatatccggaagtgctgacttaagttctacttcacccacttcatctttaaagtaatatcgggatcaatgtaatccttaatatctactttgcctgatgaaattgcctgatccaaagcctcattatagcggactgttaaatcctccagacctgcatctacatctactactcctgtaaggatcttactgtatacatcatggaaaccgtctccctcaatggataattcaccgtccggattgggatatttgatgcagtagatatccatatccgagaaccgcagccagttggggtccatatttgcagccgttgacagactggtaatctcatcaccaaggatgctgatatccacctgtgcctcgttggttgccacaaacaattcgtcagaatacaggaacttcataaattccgcaaccttatcctcatatcccttctcctttacatcggaattgatcacataagataaggacacgcccacaggctctttgaagcggttttttgcatcctttacaggataagggataacctcccactcaaaatcacaggggaactgctttttaaaggtcataacatcggaagataacactcctaccataccaatatttccggcggaaaactgagctctggccgtatctccgtccatggtttcaaagcctgggaacatgcttccgtcatcaataatatcctgcaaatgtccgaagaacccccgaaggctggaataatcatatcttccggttgtatgattaaaatattcatccccaacactggcggcattggcaagatttacataaaaataatcataggaggaatagcccatagccagcgcataaccatatgtagaaccgccgctgttttctgtaattacccgtgccgcttcccgcatctcgtcccatgtttcaggcacggtcagcccatttttcctaaaaatatccatgttacaggcaattccgtagtttgttacccggaacggaatggcataggttttatccccatatattccatatcccggcgcattatactgccggaaccgctcaaccagtccctttaagccttctatcgtctcccagggcatgatgtaaccagccttggaataatttcctatcttgttgctcttaaagatgtccgggccttctccggccgttacagccacgtccagagttgtgtaataatcactgccgtataccgtatattcaaccgcaatccctttttctttgccgatggtctcattaaattcctttatcttttcatcatatacagcctgatcatgctggtcattggaccacatccgaagggttgtgacctcccccggagccgcaggcgccccagtctctcccaacccttgggtgctattgccggccgttgtctctcccgacgtttgggcgctgttcccgtcagccgcagactccggtgcgctcccggatgtactcttgcaggctgtcaaggatgctgccatagaaatccccagcagcaacataccaatactctttgttaacctcatggttcctcctccaatataaatattttcatattactgaaaaacttttttaaacccgaaattcatgaacttcatagctgcattttaacacaaggatttaagaatgataagtatgaaaattcgtcaacatttacatttaaccttcttttcttattctttttttataaaatgttgataattcatcatattgagcgctccgcatcctaatggtaaaatatacaataaagcgaattacataccgaaaggagatatttttatggagtttcttaaaaccaaaggaaaagcaattgtcacagaatccgggcgccaggtctatctgcgaggtacctgcatcggcggctggatgaatatggaaaattttatcaacggttatccaggaacagaaatttccttaagagagcacatggccggccggctgggaaaggaaaatggagagtttttcttcaccgaaatgatgaaagaatttttgtctgaagaggatgtacgctttatagcttccaccggggcaaactgcgtgcgcctggcgctcaactacaggcattttgaagatgattcccagccctttgtctacaaagaaaagggatttaagatcctggaggcagccgtctccctgtgtgagcgccaccatttatacgtcattttagacatgcacgccatacagggctggcagaacacccactggcacagcgacaatgacgggggaatctccctgttctggaccgatgcctgctaccagaaacgttacatcagctttatgcaggagctggcccggcgtttttgcggccgtcccgcagtggccggctatgaattgttcaacgagccaagctccagctgccgcagcggggattatccctttaacatgtacgaaaatttcacctcggattacgaaaccttcaaccaggttgtaaggaatacggtacacgccatccgggagattgatccggaccacatcatctttatcgaaggcgactgctacggacataatttttccggtctggaggccccttttgccgaaaaccttgtttattcctcccacgattacatcatctccagctttggccccggcaaatatccgggacattacgaggaactgcataatgaccgggttgaaacagccagctactgggattatgaaaagcagataaatcatattaaggaaacagaaggctggcaattttccgaaaaatatcaggttcctttatgggtcggggaatttggctcccagtattgtacgggagaagaggatatgccaaaccgcctggcatccatggacgaccagttaaaggcaatgaatgagcttggtcttcactggaccacctggacttataaggactgcggcaccatgggctgggtaacggttaagccggacagtgaatacctgcggcaggtcgcaggggtccagcgtcagaagggtcttttaggagccgaaaacttcaccgcatggcgaagcgaatgcccaggcaaagaagtgaccagggaattcaccagatacatgttgtctctcctggaagaggctccgaattataccttcggcacctttcagaaatgtatgaactacgctttgctgaccggctttgccgcaggtgtcttacagccggaatacgcaaatcagtttaaaaactgcagccgtgaggatatatccagaatcatgaagtcttttgctttggaaaattgtgagaagaatgaacggtatcttgaaattttaagacagcggctggtgcaatagatgccgcagagactggccaaatgtgactgcccgccagccctttgaccaaaaaaggccgctatggaaactgcttaaagcgtctccataacggccttttatcattgcttaaaagatcccttatttagaaagaaggaactaccgcaccatcgtaggtgtcttcaataaactttttaatggtatcgcttgttaaagcttccacaagggcttttgtcttctcactgctttcctctcctgcacgtacggcaacaatgttgctgtaaagggtcgctgctactgacttggcatcctctacggccagggcatcagatacctttaagccggcctcaattgcatagtttccattgataacagccacatccacgtcgcctaaggaacggggaagctgggcagcttcaacttcaacgatcttgaagttcttgtcattttttacaatgtcattcttggtagcctccagctcaacaccttcctttaagccgatcagccccttgtctgccagtaaaagaagagctcttgcctcgttggaaacgtcattcggcactgcgatctgggctccgtcaggaaggttgtcaagagaatcggtctttccggcataaatgccgaaaggttcatagtgaatagctgctgcgcttacaaggtctgttcccttttcctcgttgaactgatccagatatggcttgtgctggaaatagttggcatctagatctccggattcaagggccaggtttggctgtacataatccgtatattcttttaccaccagctcatatcccttttcctttaggatatcctttgcagcatttaaaatctctgcgtgaggagccggagttgcgcctacaacgatcttttccaagtcgccggaagcctccttgctctctgctgccgttgtttcatctgtcttcgctgcttctgttgttgcagcctgtgttgtctctgctgcggtcgttgccggtgctcccttacttcctgagcatgcggtcagtgctcctgcggcaaccagtgctgccgtaagtacataaagtgactttttcataactttttcctccttaaaattttttatggtaacgccttaggctgttactacttaattctcttatcgctcactctggatagtttcattcctgcctcctgaatgacctggacaatgataacaagaattgccacggttataaacatcatctccgtctggtagcggtaatatccgtatttaattgcaatatctccaagtccgcctccgcctacaaagcctgccatagcagaataggccaatatggtagtgacggaaagagccgctccaaccaagagggaaggctttgcttccggaagaagaaccttccatatgatctgaagggtggaagaacccatggattttgccgcctcgatcacgcctggatccacttccttaaaggaagcttccacgactctggctacatagggcgctgaggctattaccaacgggggatcacagcctttgctcccagggtagtacccacaacagcccttgtaatgggaagcaccataatcaacagaatgataaacggcacggaccggagcaggtttataatcagacccagaatcctctgaaaccaggggatgggatagatcccttctttgtccgtaacaaccagaaaaatgcctaagggaattccgataaggtacgcaaaaaaggatgaggtaaatgtcatgaacaagctttcccatatgcctgttttaagcatctgcaaaacggttgcatcaaagatcataatcctttacctcctcatgagtgattcccgctgtctttaaataattaaggatcctgttctggtccacttcctcctccggaagctggatgaccatctgtcccatagcggttccgttaatgtcccttgtctcggcatgcataatattcaccgggaccttacaggctaatatcatattggcaaggaccggttcaaaggaagaccggccgtcaaaggaaatccggacccttctggagccgccgaaccggctgactaattccgccgcctcccctaatatgagctgtcttccgattttggactttggctcagagaatatttctgttacgtttcccacttctgcaatgtggctctggtcaataatcgccacccggtcgcagatggcttcgatcaccgtcatctcatgggtgatgaccaccaccgtaactcccatggaccggttaatatcctttaaaagccccagtatggactttgtggtatttggatccaaagcgcttgtggcttcatcgcaaaggagaaccttgggattggtcgccagggctcttgctatggcaaccctttgcttctgcccgcctgacaactgggccggataagcctttgccctctctttaagtcccacgatttccaaaagctccatagcccttttgatcccatcctttttgggaacgcctgcgatttccagaggaaagcacacattctgtaatacattcctctgggccagcaggttaaactgctgaaagatcatgcccatggactgtctggccagcctctgctcccggggccgcatagaagccagactcttattctcgaaaagcacatctcccgatgtagggatttccagataattgatacagcggaccaaggtgctcttaccggctccgctcaaaccgataattccaaatatttctccctgttcaatggacaggttaatatcatctagggccttaatggggccgtttgcggttcggaactcttttcccagtcccaccagctggataataggttctgctgactgcatatgtctatttccttttcctttcatttcttttctttaaggtacaaaaaggccgcaagccctgcacagacttgcgacctaaaaatttccgcgttttgctgctctcagcgaattccaatcacaatccatacaaatgaaacgattatcgtatttttatgcattctgatacacgacacatcatcatacacatgccgtccatcggatccatattcatctgcatggcttttaactggttcatggcagctactccttccactgattcctataggcaaactaggaattcctttatgagccgtattttacgctctcatcctgcttttgtcaatacttattttaaaatcagggacaaaaacccgaaattttatgaacacagatccacgatcacctgggcaaatatcttagcgcttaccacaagttcatcaatgaccgcgtactcgtcggctccatgcatgcggttatctgtccccggcatggaagcgccgaaggcaacgccgttctttaattcatggacataagtaccaccgcccatggacacgcactctccctttaagccggtatagctttcataaacattcagcagggtttttacgaattctgaatttccatccacgtgatgaggcggtctcatggaatcgttgtgaagggtaaagcccttttccgtcatgttcctttttacaacctccagaacattttcttctgtagcgcagacagggcaccggctgtcaaaggttccttccagacaggattccgttacctttaataagctgaatgccagagtcaggctgccggaaagctcatcttccatggcgattcccagggcttttcctgaagtgtccccatggggaatcagctccaaaaggcggcggatcatggtcacctgccggcactctgccaggggaagcttaattaaatacgaaagaagtcctgtcagggcattgtttccctcctcagggagggaagcatgggcactttcaccgattgccgtaatggttgcggtgtcttcttccagctccagttgaaaacgaatccctgttttcttttcacactctgctgcagcatgctcaagggctttggcgtcaatgcctgctaccactgcagtagcttttccaggcaccacatttacctttgttccggcatttatgcttaccagctttggaaagctggatgatggagcccactcagcggtaaaatgaccgtttaacccgcctttttccgtattcaccaccggaaaagagccgtcaggagaaaaggtcatgggagcttcctcttctatggcataataatgggcaatgtcagagcttccgcactcttcgtcggttccaaggatcagccggacatttttcttaaggggaatattcagctcctttaccgctctcatggcgtaaagggctgcaacagccgggcctttgtcatctgctgtaccgcggccaaacagctttccttcctttgccaccggctcaaagggttctgtttccttccagccttctcctgccggaaccacatcaaggtgagccaggatatcaagctggcgctccttatcatttaaatctgctgttcctacataattatcgtaattggtaatggaaaaaccgtaggattccgcgattgccagggcttcagacaaagcctcaaatgctcccttcccatatggcattccttccctgtaggccatcttttcgctgttaatacggcacagtgtgcagatgtcgtcgatcatctcctgcttatgtgactctatatattcctcaatttccttcctgtacatggtccacaccccttttcttacttcatcatagctgccagtgcgtcatttacggccttgccatccgcttttccttttaccctgggcatcaggaccttcatgattcttcccttgtcagccccggtgggagtttcgattcccagttcctggagaacagattgaatgatttccttgatctgctcctctcccatatcctccggagcaaactccttataaacggaaatacggaacgccgcttcctccctgatatccgtcctgtcctcaggcgccaggtcatgagtctcctgagtctgcttgatttccttctttacaaccgcattggcctcatcctcagtaatgggagtgtgatccttcttatcgatctcaaaattcttaagagaggaaaggagcatggataaggcatcctttctctgcttgttctttgccttcatggcctctaccatggctgcccttacttcatcaattttactcattgtctgctgcctccttatatattattcttcataaactgttcccggatttccggtatctgatttatacgggttatgacttagctatgaccgaattcggaaagcctcagtcccggatttcgctccaacaccatgcctacgctccagctgttgacaaataagagaagcggattgtcttttagatccttgatccgtttcatatctgatgttccctgaatctttgccacatcaatttcatccttattctcgatccagcggatatattcatatggaagcttttcaagcttcacttccacattgtactcgttttccagacggtaggtcaatacttcaaactgcagttcccctacaactcccacaatgatctcctccattccggtattaaactcctggaatatctgaatggcaccttcctgtgcgatctggttcacgcctttgataaactgctttcttttcatggtgtccatctgcctcacccttgcgaaatgctccggtgcaaaggtgggatcccttcatattccaatttctcattggatttgcaaagggtgtctccaatagaaaagatgcccggatcaaaaacaccgataatatcccctgcataggcttcttccacgatcttacgatcctgggccataagctgctgaggctgggataagcgcagctttttgccgccctggacatggttcacctccatgcctgcgtcaaacttaccggatacgatccgcatgaatgcaatgcggtccctgtgggccttgttcatgttggcctgtatcttgaatacaaaagcggaaaagtcctcttcaaaggggtccacaactcctgttgttgtcagccttggaaggggagaggttgtcatctgaagaaaatgctgcaaaaatgtctccactccgaaatttgtaagtgctgaaccaaaaaatacaggagacaagtctcccttgcctacccgttccatatccagctcatcgctggcgccgtcaaggagttcaatatcttccataagctgccggtgatagctttccccgatcagtgtatccacctgggcatcacccagctgaacttctgttgcctccacttccttctgcccgttcatggaagcacggaatgtggttatggtctctttaaagcggtcataaacccctttaaaatcccttccgcagccaatcggccaattaaccggacaggtcctgatcccaagaacttcctcgatttcatccatcagttcaaaaggatctcttgcttcccggtccatcttattcacaaatgtaaaaatggggatatggcgcataacgcagactttaaacagcttgatggtctgagcctccacacccttggaaccatcaatgaccatgacagcggaatcggccgccatcaaggtacgataagtatcctcggagaaatcctggtggccgggtgtgtccagaatgttaatacaaaatccgtcgtaattaaactgtaaaacagaggaggtgacggaaatacctctctccttttcaatctccatccagtcggaaactgcatgcttggcaccttttcttccctttaccgttccagccaggttgatggcccctccataaagcagaaatttctctgtcagcgtggtttttcccgcatccggatgggaaataatggcaaatgttcttctcttcttaatctcttccgctatattcacaaaaatagttcctccaaattttacgtctcaacttgtctattgtagtatgattccaaccataagtcaagattcactcttccatagacaaacggatatcctcaatccgctccgctgcttgattcggttaaaaatttgaaatccacgtctttgcaagcgaaatccagctctgacaggaaggttcaaggaggttctcatcggagcccgcggtttcctcattggccagggacagaccatggactcccgcagggtaaacatggagttcaaaattcacatgatgctttctcatggcgtcagccaggagaagggtgttttcaaggggtaccgaagcgtccgtataggtatgccataaaaaggctctgggcatcttttccgttacaaaccgttccagggatatgccttccgtttcctcctttgttgcctcttcacctaaaaggcttaaaacagagccggcgtgtttaaattccccgcttgtgattaccggataatttaagatcagcccatcgggccgtatttcttcaggggtcctgtttatggcctcccacgcaaaatctctgtcccagaaaaccccaagactgcaggctaaatgacctgctgcggaaaagccgcatgcaatgatcctgttcgtgtccaccttccattctgccccatgttctctgataacagccaccgcttcagcaagctctcttaaagaaaccgggaaacggttgggagccacgctgtaatccagtacaaacccatgacagcccatggacatgaactgcaaagctattggctcgctttccctgtctgatctgcggatgtatccgcctccgggaagcacgataacagcagggcgcagcttatccggattcacgcttatgctgtccagtaaataaccggtcaaacttgccggacctgtcacctgcccaggtacaatgatctgccttttttcaactctcataatgtcttactccttctttccctcattctgactggaaaatatctcgtccagaatgcggtgggccacttcatcttttgtcatcgtttccaggggcagttctttttccctggtaatgatggtgactacattggtgtccgttccaaaaccggccccagccacttttaagttgttggcaacaatcatgtccacattctttttatcaagctttgcccttgaattttccagcatgttctgggtctccatggaaaagccgcagaggaactgcccttctttccgatgctctcccagccacttaaggatatcgtccgtccgttccagttctataaccatttctccgtcttttttctttgttttttctgttcccacatgttttgggcggtaatccgctacggcagcggccttaatgaccgcatcctgagtttctgattcagccgtgaccgcatcaaacatttcctttgcactgccaatctctatgaaacgcacaaacctgggctttggaatatccgttttcccgcttacaagggtcacctccgcacctctgagagatgcagcctttgcaactgcataacccattttcccggaggaatgattggtaataaaccggaccggatcaatggcttccctggtgggaccggctgtaaccagaattttctttccggctaagtccttttcataacagacctctttttcaatgaaatcaaagagaacctccggatccggcatttttcccgctccaatatcgccgcaggccagatacccaaagtcagggcgtatcacttccatgccataagattcgcaaatctttaaattatcctggacaatgggattttcatacatattggtattcatggccggagaaatgattttcctgcacttacaggccagaacagtggtggtcagcatatcatctgctattccatgagccagctttgcaaccacattggcgctggcaggagcgaccagcaccacatcggcaagctttgccaaggccacatgctccacgctgtactgaaaattgcggtcaaaagtatctaccaggcatttattgcctgtcaatgtttcaaatgtaatgggattgatgaagttggtggcattccgggtcatgatgacatggaccttgcagcccttttttaccagcatactggcaagtccggctattttataggccgcaatgctacctgttactcctaaaatgatagtttttcctttcagcataagtgcctcctgtccgatgagccaaaggcaaatcaaacttccttgtttttcattttaaaatatggtactctacaatatatcatgattctgcgaatcatgatccacattcaccgttcgcgccgagaagcaagcttctcttcgctctcttgcgctattatatcatgattctgcgaatcatgatcacattcaccgttcgcgccgagaagcaagcttctcttcgctctcttgcgctcattatatcacaagaaaaaaaagttggaaaggagttccctttatgattttggccattgatatgggaaacagcaatattgtcataggcggcattgacaataccggcacttattttgtagaacgagtcaccacgaatcatggaaaaaccgagctggaatatgcggttaatataaaagacattatggaaatccacaaccttcccctctcttccatagaaggtgcaatcctggcttctgtcgtccctcctctcacggatgtggtcctgagcgctgttaaaaaaataacaggaaaaacacctatgctggtgggatccggaatgaagaccgggctgaacataaaaatggacaaccccaagaccgttggcagcgatttgattgtggatgcggtggctgcattaaaagaatatcctgctcccatcatcgtcatcgacatgggaacagctaccaccatgtccgtcattgaccggcagggaaattactccggcggcgtcattttccccggattgagagtatctttggattccttaagcagccgggcagcccagcttccttacatcggcttaaacaaacccaccagggtgatcggcaaaaataccattgactgtatgaaaaatggaattctttacggcaacgccgccatgatcgacggactgatcgaccgaatggaggcagagcttgggacttctgcaagccttgtggccaccggcggcctggcttcctccgttgtcccgctgtgctatcataaaattcattgtgacgaggctctcctattaaaaggattgctgattctgtatgaaaaaaataagctggattaataatgacctaaaaactggaaataaaaattgattcggctatcgtataaaagccctcgaatgagtacatcatttctttatgatagtcagataccctgcaggaagctgcaaagtatttgaccccgcaggcaatccaggatcaagcgagcttgattttggctcattgcctttgcgggaataaaaaatgatgcggagggaaagatatgtctggatacaaagtagagatttgcggagtcaatacttccaaactgcctcttctgagcaacgaggaaaaggaagttctgttcaaacggattcttaacggagataaaaaggccagagaagattacatcaagggaaacttaagactggttctcagtgtcatacaacgtttttcaggcagcaacgaaaacgtggacgacttatttcagattggctgcatcggtttaatcaaagccattgacaattttgatattacgcagaatgtccggttctccacctacgcggtgcccatgattttgggcgaagtacggcgttatcttcgggataacaattccatccgtgtcagccggtccctgcgggataccgcttataaagcaatctacgccaaagaaaatctgatgaaaaagaacttaaaggagccgacccttatggagattgccgaggagatcggagtcagcaaggaagacatcacctatgctctggatgccattcaaagcccggtcagcctttatgagccggtttactccgacggcggtgaccctctgtttgtcatggaccagatcagtgacaaaaaaaacctggaagaaaactgggtggaggacatctccttaaatgaggccatgagacgccttccggaaagggaacgccacatcattgacatgcgctttttcgaaggaaaaacccagaccgaggttgcggaagaaatccatatcagccaggcacaggtaagccgcctggaaaaaaatgcgctaaaaaccatgaagaattacctttcttaagcatgattttctttacaaaacataagcccacctttccagtcaggaaggcaggcttttacatattccggagagatttctccctttcttttgacatatcaccatcaaaaaagtccggcaattcagtttcctgatgatctattccccaaataccttgcggtagtcctctttaaacttctcaatcccctggtctgttaaggggtgctttgtcatctgttcgattacgctgtaaggaaccgccgcaatatctgccccggcttttgcacagccaatgacatgcatggggttgcgcacgcttgatcccctcagaagacagcacctttgtagcctttaacccttccgcagatcactcccatgtcattggcttagctgatatgctcaacatttgccgtgtctaaaaaaatctcatttctcattcctccttaaaagtttcccagaacgcttcacccatgcagtcctcaaatgacttttttaatcaaagtctatactcctgtcttctgaccgtaataagcattggtcccatgctttcttaaataatgcttatcctgcagctcttcaggcgcaggggctgcctttggattgatctgttcacaccggaatgccatcttggccacctcttccagaaccactgcatgatgcacagcttcctttgcatcctttccccaggtaaagggccatggtttttacataagcaggccggaactgccatgtactccttattcttgaaacagtctgtgataagaagtcccgtatttttctcgtacccggcctcaatctcttccgctgtcaggcagcgcaggcagggaacctctccgtatatgtaatccgcatgggtggtaccgtagcagggtatcccccgccctgcctgggcccagctggtagcccaggaggaatgggtgtgcacaattcccccgatctttggaaatgccttgtaaagctctaaatgggtgggggtatcggaggaaggattataccttccttccacttttctcccctctaaatccatgaccaccatatcttccggtttcagctcattataatccactccgctgggcttaatgacaaacatgcccgtttcacggtcaatggcactgacattgccccaggtaaaggtgacaagtccataccttggaagctccatattggcttcgtaaacaagctgctttaaggcttctaacatgtgttacctcctatagtatcatgtgcaaaagcacatgatcaacattcgccgctcactgcaaaagcaagctcttaaactcacttgcactcatggtataagtgtgtacatggcaatttcatcaatcccatgattggtggagatgaggatctccttcccgtcttttgtatacttatatacattggcagggccgcagtccctgtccaatatctgcacctggtaagaagcctggacaggatcataggtaaaggccaaaagattgcgttccccttgccggtgaccgatgatcagggccggcttgccgtacagcatgccccgaaaatggcatgattgaattgtgttggccggtcataaacatatacttctttatattccccgtctgtttttttccagatgctgatcttatccccgtgaaatggagaaataacagctaattccttctctccgtcctcatcaaaatccaccagcaccgcatcgctggccgccgctttgatcagccggcagatctcccaggaccctgacggctgctccggcggaataaactggtaaaccccgctgtcgcaggatataatgctggtctggatcccctggtcctccaccttgtaatatccatggtttttaaacatgccatccttgatcacttccagccggagctgatgctcttcatcaaatccgcttaaatcctcaggcaggaccgccccatacacctttccgggagaggaccagtcctctttgtattcatggcctgattttaaagtgcacgcgatcagatagttggtgccgttccgttctatgatatggaaccggtgtacaaagggaagatccgccaaagttcttacctcccagccgttttgcccgccaggagtcactatgactatttttgcttccttggaatcattgggagaatagaatttatgagttgccagaaactgtccatccgtacccgggatctgaaccatggtcatcacgccgccaggctccgtccagatcgtgtcttccagattgccttctgtgtcaaacagcaggcagcggtccatcttttccgccgcgaccaggatgtgatcccttcccttgtagtgaagcggggcaatggaatagcatttcgttaaatttcccatcacctttttttcaaccttcatcatcatttttcctttcactcctgtgccatcaatattctggacatttttagatttgccgaagctaagtcttccttccaggaagggcttcccgtgtaccagaactctgttacatatttccttactcccagcttccaggccgtctcaatggccttcttaaaatctacatggccttctccgtatgggacctcacggaatatgccgggttttgtctcttttaaatgcatggcggccagacgcccgcctccaaaccttaagtcttccaatacatccgttccataagtacatgcggcatttgttatattccctatatcaggataaacgtttaagtacacggaggagatctgcttcacatacttcatggccttttccaccgtattcatgaatccggtctccatggtttcaaatccaagaacaactccggcgctggcagccatttcagctgctttttttaagttgtcctcaaaataccgccttgtttcctcgtcggattcttcataatacacatcatacccggccagctggatgatcctgattcccagatctgacgccagatcaatggctttgctcatgatctctatgctttttttctttatttcagggtcatggcttcccagaggatacttccggtgcccgctcagacacattgtccctatgggaattcctgcggccttcatcaattttatcagctccagccgttcctttgaagtcatttccagacgtcccagcttttcatctgtttcgtctacactcatttccaggaaatcaaagcccgcgcttttagcagcctccagcttttctttccaggttaattcagacggcattgacttttcatacaatccaagtgtataggttttcacctaaaaacctccttttttcacctggtggatctgcactccagcctccttaaattcttttaatatatcttcaggcgctttttcatcagtgatcaaatgctgaactttatttatgctgcagcttgaaaagctgctgtttttccctattttcgtatggtcggccagaatatacagctcgtttcttgtgtgctcgatcatcagttcgttaagacacacctcattcatgatctccgtggtcattccggacatgacggaaatgcctgagcatcccatgaaagccttttttgcatagatgttctgaaggttcctgaccgcaagatctcctaccatggcttctttgggataccggagttcccctccggtgagaatgatattcaccccggttccatgttcactgttgatcgcctttccattgttggttatgaccgtaacattcctggccttgatgtattccaatatctgcaaggcagtgctgcttgtgtttataaacagcgtgtcattgtcttccaccaaagttgcagcatagctggcaattaaccgcctgtaaagtaatatttcatttgcttgtgcagggcctttttcaatgggaatggcgccgccgtgacagcgctttaaaagcttcctgtcttccagatactgcaaatctctccggaccgttattacagaaatcccgcactgctctgccaagctgttaacggacaccttggggctgtttcttacgatatctaatatatgctctcttctttcctccacaagggcatactctcttttcatcggctcacctgcacttttatcaatatttgatcactgttgcgatccacagtttatgtgacaccgcctgccggaggttttcatccggcagacgaaaatttgattggttaaatttgattggttaatcttcctgaatgatcccctgctcttttaacttggtttcaatttccggagcagacatcacattcttaaggggaatgatcttaacgccttttttctcggcatgtgcaaacatatccttgaaattctgggcacagaccaccacgtcatactggggagctgacccctttccctcggaaagggcacagtgatggaccttcaatgctttgatattatactttttcagcaccttctccaaagtcatctgtgccatcaggcttgaacccgccccatttgcgcaacacaccaaaaagcttaaatttttacctgccacgatgaaaaccctccttgatctcacttattccttgtttgtcttcatttctttatacgcttcataatcctctgtcataaggaaataaccttttttatctttccaatactggatctggggaatagccagcaatgcaaccagtaccaccgcaataccaacatagcttaaatacttcatgacaacggtaaataccggccatacgaccgcccaatcccacattcctaagtatccgccgtaggctgccatgcctacccagcctgcaatgaaagcagaaccaaatacctgacataagccggacaggaagggaagaaggagagccgctttaaatccgcccttttcatttgcaaaaacaccgatggtggcattatcaaagaacactggaacgaaaccgcatataaccagtaccggactctttaataagatcaacgccgtaatggccaggatctgtcctgcaaagcctgataaaaatcccaaagtcacagcatttgccgcaccaaagccaaaaattacggcacagtccactcccggaacagagcctgggaggattctgtctgcgattccctggaaagaggctgtcagttctgccacaaaggtacgcacgcctaactgcagaattgccagatacactgcaaagtataaacaagtctgaaggacatagaaaaacatacttgctccttctttcataaactgtccttcaatcagataatccctgccaaggatacaaagaatggccccgaaaaatacaaccattaagatggaagtacacaccatattgtcattaaagatggacataaaaccaggcagttcaatatcttcgatctttttaacttctttcccgttgtttttcttattttcttttccgaacagctttcctgcaaggtaatagctgaccgcaaccccaaacatctgctgatgtgccagacagaaaccggctccatctgtaacctcctggcagggcttaatggtcaggtttgaacccactgcccagtaagctcctaaaagaagggccataaccaccagcatggcaactcttccatttaacaggaacggacaggcaaacatgatcagccagtatgcggtcgcagcctgctgcacctgaacattaccggtggtaaacagggcccggagctttgtgtattttgaaaaacgcacaaggaggatgttgacgataaatgcaataaacaacaggatcatcgcatccccgaatccttttccaaacacttctccaacgcctgccgtaacggcattctgaccgaaataaggatctattaccatggcgtctatatggaacctgtcctttaagcctaccagtaccggacggaagttattgaccagtccgccggaaccaaccattaagatcaaatagcccacgatcgcttttaaagtcccagccagtatatcataccacggttttctcagcaagatgtaacctatcataacgatcaaacctatcataaacgccggctgctgtaatacgtttgtggcaaaaaaagtccataccttcattaaaatctccattgtattatccccttttccttaatccaagtatcgttcctgaatccgcagcaaatcctctgaatctttggctttcttaagttccccgatcacttcttcattgctaagcagttctgacagccggctcatattatccagatgctggtccggattgcaggaggccagcgtaaagaaaagctgcgcgtccttttccggatcctctgcatcaaagctcaccggcttttccagtttcatgaaggcgatgctggttttatgtaccccttttgcgccctcctgggaatgaggcatggcaatgtccggcaaaataatgatataaggtccgtacttcttaatacaggcaatgatctcttccttataatttgcttctaccgtcccatcctcttccagacactcacagctcatccggatggcatcctcccaatcctttgcttccccggcaaacttataatgtttcttctccacaaaatctctcagcatgttttctcctctttcctgattacaaaagtgaacggaacggaatattctgaggtgcttcaaagcagtcctcaaagcctcttctgtggtggtaagccagcttgtccttatccgtgggataaacgtattttccgcctacctcccagaaaaagggatggaacctataatccaaccggtccttcttcatatcatagagtaccctgatttcattcacatccgccatgaaattggtccatacatcgtagtggattggaatcaccaccttacaccttaaagcttctgccatgcgcaggatatcacaggaggtcatcttatcagccattccaaccggattctccccataagatccaaaggccacgtcaatgtcataatctttcccgtgctttgcaaaataaatggagtaatgggaatccccgctgtgataaatattcccgccgggagttttgattaaatagtttaccgctttttcatccatatccatagggcactttcctgtcagctcctcacggtccgggccggtggaatctgttgtcacaaggcaggtcctgtcaaaggaatcaagggccacgatctcaatatcctttattttaatactgtctccaggcaccaccgtaatgcagcgttctgccggaactccccatttctgccacagctccacagatttcttagggccgataaaaggaacaggaatctcctttccattctcatccactgtagtcatgttgctttggatcacatgtgcagcatattccaggctcatatgatcctgatggtaatgggttgccagtacggcatccacatgcttaacggcaaacggatcgattacaaaaggaaccgccctcaaattaggctgcattgcccttgcaccgcacatatttgccatctgatggcccacggccatctttccgtttccatgagagcgttttccgttcccgcaccataaatccacggtaatgttgcagccgcccggagtcttaaaccacatgccggtacagcccagccaccacatggcaactgttccgggttccactgtctcattttcaatttcttcattgagccaggttccccattcaggaaacgtgctcatgatccagctttcccttgtgatttcttccactttgctcattcaaacatcctcctttacttttacgatcgttttatgatcggttatgttcgtttttatctttacatgtagataatatcattactataccagtttttcaagagcgttaaatgatcgtttttgaattatatgtttgttttaaatattttgtgcattttatatatttttacgataattatttgtacatatttttcacttatataaaactctatattttttaaacacatttttcacaatattatctgtttttttatccgcatataattcttttttatttatccagcattttatattatgattatataatcgtaaacacattcaaagcatggtaagaagccacttcagaaaaccacaaaaaaagacttcctgtaatcattcggatttaatcagtcaatcggatatttacaaactgcttcgctgcttgtctgattcggttaataaaaccggagaatctgtatagcccttattttcacaggcgatatgcatatcctctcacccatcccatcaggaatcgccaatattctttagcaactaaagtatattgacagcagattctataggtgctatactaaattcgcaattaaaactgtaatcaaccattgttctgtaagaatattggaggggatggcgatatcattttaccccataactcatgatgaattgaaaggaaaaagacatggagtgcaaattaatcggaaacttgtttgatgtgattgctatgatcacagatgagcaaagatgccctcaaaaatataacgagtcccatttgctgtatcatgcagaaatgaatctgattgacacgatttatgaatatcccaatgcaaatgcccgtatgttgtcggagattatgggcgtcacccagggcgcgatcactcaaatgacggcaaagctgacagaaaaaaatctgattgagcaatataaactgtccgggaacaaaaaagagaaatattacaggcttacacaggagggtgacaaggcaaggctgggacatcaggaataccacagtgaggccaatcaaaaactgtgtcaatatttctgctctctcagcgatgccaacgcaagagttattctggacttttttgaaaaagtaaaggaatgtatgcctatcagtgagtttgcctgtcaatcaggcggcagctgtggaaacggtatggaaagaaaggaggaataagatatgcttactatttcgggattaaaagcttatgcaggtgacaacgaaatcctcaagggggttgatttaataataaatccgggagaaacccatgtgatcatgggaccgaacggcgcgggaaagtccacgctggcaagtgtcatcatgggtcatccggactatacggtgacggatggacgaatcctgtttgaagatgaggacatcacctataccaagacagatgaaagagcgagaaaaggcatctttatgacatttcaaaatcctgaggaagtagacgggatcaccgtggaaagctttctgcgcacggcgcggtttgcgatcaccggcagcaacgaacgggcctgggacttccataaggaattaaaggggcttatggcacgtctggattttgacgagagctacgctgcacggtatttaaacgtcgggttttccggcggtgaaaagaagaaacatgaaatacttcagctgctggcacttcacccaaaactggctattttagatgaaacagattccggcctggatgttgatgccgttaaaacggtatcagagggtgtaagaggctataaaaacgaagaaaacgctctgcttatcatcacccacagcacaaaaattttagaaaatatcaatgttgatcaggtgcatattttaattgacgggcagatcatcaaaaccggagacgcctcgctgattgatgaggtgaaccgcagcggcttcacttctctctcacttaccaaagcagcccagggggtgtcataatggaacgtaaaaagacgcaggttgcggaaatcaaccgtgatgcctatgacattgccaatccggaaaatgccgcgtataaggtagataaggggctgactgcaaaaatcgtcaccgatatctccacaggaaaaaacgaaccgggctggatgctggaacaccgattgcaatccctcgccgtttatgaacggcttcctttgccaaattgggggccaagtcttcacgaattggatatgaatcatatcgtcacctatgttcgcccgaatatggggatgacggataattggaatgaggtcccggaagagatcaagcagacattcgaccggctgggcatcccggaagcagaaaaactggccctctccggcgtgggagcacagtatgattctgaggtcgtttatcacagcattaaggaagaaatgcgccagcagggtgtcatttacaccgatatggataccgctctccacgagtatgaggatatcgtaaaaaagcactttatgaaactgcttcctgccacggcacataaattcgcggccctgcacggagcggtctggtcaggcgggtcctttgtctatgtgccaaaggatgtcgaagtcagcatgccgctgcaatcctatttccggctcaatgcgccgggagccggccagtttgagcatacactgatcattctggaggaaggcgcgcggcttcatttcattgaaggctgttccgctccccggtataacgcgctgaatctgcacgccggctgtgtggaactttatgttggagaaaacgcgactctgcggtattctaccatcgaaaactggtcgaggaacatgatgaacctcaattcaaaatgcgctgcagtggaaaaaaacggcgcaattgaatgggtttccggtacatttggttcccacatcaccatgctgtatcccagcagtattttgcggggagaaggtgccagaagtgagtttacgggcatcacctttgccgccgcagggcaggagctggataccggcactaaggtaattcacgccgctcccaatacctcatcaacggtatcgtcaaaatccatctccaaaaacggcggaaaagccatctaccgcagcgctgtcaccgttttgcctgaagcgaaaaacagtaaatccagcgtaagctgtgaatccctcatgctggatagggaaagccgctccgacacaatccctgtaatggatatacgaaatgacgaagtggatatcggacacgaagcaaaaatcgggcggatcagcgaagaaacggttttttacctgatgacacggggaatcggtgaaaatgaggcaaaggcattgattgtccgcggtttcgtggaacccattacaaaggagcttcctttggaatacgccgtggaaatgaacaggctggtggcccttgaatttgagggcggtatcggttaaaaggaggttggcatgaatcaaactataaaaaggcttaacaagctgcagattccaacatggaacgcactgaaaataaacgatacgtctgttgtgaccgatcttgacggaatgcccgcctatgccgggaatccaatgcaaaaggaatattccgggattcagatcagccatggacctgtattgaaagcagcagaaaatcctccggtcatccttggggatatccggagatacgcggcggaccttaacaattaccgcctgcatatcaccataccggcggggttcgcggcaaaggaaccgattatactggactttcatctcgatagcggcagcgctctgctgtcggaggagttgtttatcagcgcagaagccgggagcgatgcaacagtggttctgcggtattcatcagacgacactgcaaactgtttccactgcggatacacgacccttcatgtaaaagcagacgcaaatatccggctgataaaggcgcagcggttggcagagaatcataccggcatagacgcaacagaggtaaatgtggatacaggggcagaggtgcatgtggtcctgattgaagcaggaacgcaaaaatccgtctccggctgcagcatacagcttacagggaaaggcgcgtccgctgatttagacggcgcttacgctgtaaaccgcaaaagggagcttgattttaattaccgcattgaatacaaggagaaaaatacgcaagggaatatcaacgtccggggcgtgcttctggacaaggcgcgcaaggcagccaaaagtacccttgattttcttccaggtgcggcaggtgcgaaaggccgtgaagaagaaagcgtgttggttctgagctctgatgcggtcaatctttccgcaccgctgctcttgtgcggtgaggatgatgtggaagggcagcacgccaccactacaggcaaaattgacgaaaacaagctcttttacctgatgagccgggggataggaaaaaacgaggcgcgcaagctcattgcactggcgtcatttaattctgttttagaaaaaatagaaccagagagcctgcaggaagaaatttcctcattcattaaggaggtgctgggcgatgcggactaattactcagaggattttcctctgctgaaaaacagcgtggaaaacggaaaacgattggtatatctcgacaatgcggctaccacccaaaagcccgcacaggtgattgaagccgtaggaaattattaccggcagtacaacgccaacccccaccgggggcatatcccttaagcgagatagcaacggaagcttatgaaaccgccagggaaaaggtcgctggtttcataggtgcaggaggtccgggggaaatcgtgtttacgaaaggaaccaccgaatccctcaatcttgcagcgggcacttatggcatggatatcctccatgaaggggatgaagtcttgatctccatcgcggagcaccacagcaatttaatcccatggcaggccgctgcaaaagcaaaaggcgcgcatcttaagtatctttacactgataaaaacgggaggctgacgccggaagaaattgcctccaaaataaccgcccggaccaggatcgttgcggtcgctatggtttccaacgtattggggatcgttaatcccattggggaaatcgtcaaaaaagcccatgaagcaggcgctgttgttgtggtggacggcgcacagggcattccccatctgccggtcaacgtgcaggcattggacgtggattttctggcgttttcaggtcataagctgtatgctcccatggggatcggcgttttgtacgcaaaagaagaacatttgaaaaaaatgcggccattgctgtttggaggagggatggtggacgatgtaagtgaacaggcagccactttcgcagacggccctgcaaaatttgagggcggtacgcaaaacgtggaaggtgcggtgggcctgcactcagcaattgattatctggaaaatatcggttatgaacagattggacggattgaacatgagctgaccggatatgcgctttcgcgcctcacttccctcccctacgttacagtttacgggcgggaaagcggccatgaccgcacgggcgtcatttcctttaatattgacggagcacatccccatgatgtatccacaatactcagtgcggacggcgtggccatacgttcaggacatcattgcgctcacccgcttatgcggcatatgggcgtgaacgctacttgccgggccagcttatgcttttacaatactaaagacgatatagatgttttgatagaatccatatgcaaggtcagggaggtgttgaagcttgaatctaaatgagatttatacagaaataatcaccgaacacagcacctccacaagaaaccgccgccatctggaacaggccagcgtcagcctggcagggaaaaatccaagctgcggggatgaaatagaacttgagctgctgatcgagcatggccagatcacggacgcttccttcaccgggataggctgcgccatttcccaggcatcagcttccatgatgattgacctgataaaaggaaagtctctctccgaggcaaaaagtctcgccgaattgtttaccgcaatgatacagcgtaaaataacaaatgaccaggacttggagccccttgaagaagccgccgcattaaaaagtatctctaatctgcccgcacgggtaaagtgtgcggtaatgccgtggcacactcttgaaacagccgtagggaggtctgataccaccagccagctgtaataaacatttccttggtactattttacagcttcaatgtaaaattattggtatgcatcatattaacggaaaggtcccagccggcggtatgtcagaatatgacacgccgccggctgggaccttcctgttataatcctgttacgtcctttggtatggtgaattccactgcgcccatgtatcccggcgccacttcatactcgtcaaatacgatcacaatctctccattttcattaaaataaaagctttcatctcctgtgatctgcttgaattcgtccgtaaagtcgtctcctgtattataaaaatacattttggaatcatctgcagccatttgttccgtcatctgctttttgatgttatcgcttattgcagtaatatagtcaggcttatccttcattaaatcctttaaagacactacatttcccgtctccttattgatagtgaaaattttcacagactctgctccgctggccataataaccgttgtattgatccgcagggaaaggtacttctcgttgtccgtcacaacatcatagctggaagttacggaatagtggccgtcacctgccaaatctccggccacctgcttttcatattcagaaatcagctgatccgcatattcttcaatggatcggtttaccttgtcgttgtccttttcattgatggaaaccttgggaacatctatttttgcctcataattctgtttggaatcctcaaaggtgcgaaatgtcacaacctttgcgattgccccaagaaccgggatatcttccatggcgtttgcggtaaccgggctggcatttgccatgattataatagccgccatagcagcagcccctgtcattgctgttcgttttgtcattttcatcatctgaattctcctcttctctttttttgctttctcaattcctgccattactcccttgcgggcagcttccggcacggggatatgatggtattcctctttcatcttcaacagtttttctttgtcactgtgttccatagtaactgctcctttctttcctaagtagcctcgggttccagcacaatcttcagtttcttaagagcccggtaaagcctggccttaacggtgctcacgttcatttccagaatttcagcgatttcttccagtttccattcctctatatattttaaaatcacaatggtacggtccttttcctccagggaatttaaaagctctaagtaatcttcttctttataatgatcctcatgggagatctccacctcatcaagacttacgtttacccgtttctgcttccttataaaatcaatggaggcattaatgacgatccggtaaatccaggtggataagtaggttttttctctcagcttcctgcattcctttatcacccggtatgcgctctcctgaacgatatccagggcatcctgttcattttttacataactgtacgcaagccggtaatatgactcataattttttaagaggattctctctgcctcttcctcaatcttttgtttcattttttcctcctctctggggttctatctattagacgtattataactcaataaaagttgcatgtttagaaaaaaaaagaaaagactctcatgagcctttcctcttttcatctaaaatatgtcactcaaaccgtacgatttcttttttcaacctcttcatgatcttcttttccagccttgatatgtaggattgggatatgcccaataaatccgcaacttccttctgggtcatttcctccccttcctcatcggtcaatccaaaccgcagttccacgatcttccgctctcttgggcttaaacggctgatggcggtattaagaaggtttcgttccacctcggtttctaaatccttatagatcacatcctcctcagttccgagaatatctgataaaagaagctcattgccatcccaatccacattcaaaggctcatcaatggaaacctccatctttgtcttattgttccggcgcaggtacatgagtatttcgttttcaatgcagcgggaggcataggtggccagcttaatgttcttagttggattaaaggtattaatggccttaataagtccaatggtacctatggaaatcaaatcttccaccccaacgctggtattatcaaactttttcgctatgtaaaccacaaggcgcagattgtgctcaattaactctgattttgccttttggtcatcatcgctgccaagaaggccaatgatctgcgcctctttttcattgtccagaggcggaggaagaatatccgcgcctcctatataatggatctctccctgatttggcatcatcagcgttttaaatgttggaattgccttaaactgaaaacggtttggtacggatacttttataatcatgcgatactctctcctttacatcattcactcactcttcatgcagcagcatctgatattctcctttttcggataatgccattttgcacacggccaccagaggcctctcaatcaccttcacttcatccccttgacgtacctccatctcgtctaaaaagattccgggcagtacgccgtcacttttcccaacacttccaaagggaatgtaaacgacctctgacacactttcgcagagttcccggacggcctcataggtcacaacatggacggcccggcgacttaccggttcgtacagcctgtttcctgtatcaagcaaagctgtcacaacctttttctttcccctgtaatgcatggtaacttcataaaaattgctctttccctttagcatggcggaaatctgccgcagaaagcagcggattccaaagtaagtacccgctgctaaaaaaatcaaccggtaaaagggtatggcctcctgaccatttcccctaagaatctgttctatataatagccggccttcgtatgctgatatagggcatccattattcctgcagctgtaaccgcagccaggtaaagagctcctaccgctttcccgatttcctttggtctttttacgtcgaaagccgtcacaaccatcagggtgctcaccgccaaataggtaattaccatttcaagccataggggtaaaaatggaaaggcggcagcaaacacagcccacgctgcccccaaaatcgccccaagaatcattctccaccatatgagacggtacttcagcccccttctcacaatggataataccagaaaatccatggcaaaattaataaagaacaacacatcaatgtacaggtttatttccgtcgccgcattcacctcccgccctgtacgaacattatagccagtaagccattcagaatttgtcaaaaccatggggatgattccaattttttatcgcctttttccatcctgacgcggcatttgccgacagattcttacagaccatacgttccctttggtctttcctgtccctcttcctgacaaatggacaaaataaaaaagggggcttcctcccctgctgcgcaagaaaaaacagccggacacagcattttctgccatgttcgactgtttttcacattctgttccagattgtcgattttccaagacggagatttaagaaagctgggaaagcctttcttttacctgatccatcatctgagcatatttctcaagctttgctttttcctcctcaattttagatgcaggagccttgctgacaaacttctcgttgctgagcataccctgaacccgggcaagctctttgctcaagcgctcttcttctttctttaaccgctcaatttctttctcaatatccaccagttccgcaaaaggcatataaatgactgcctgatggattactgcggataccgcatcttctgctatgccgcttttatccttctgcaaatacacttcaccggcataacccagtgtggcaaagaacaccttgctgcgctcaaagatatcaagaatctcctgattctcagaaacaacataaatctttgccttcctgcttgggggaacgttcatggacgtacgcacgttccggattcctcttacggcttccttaatggtttcaaccgcatgctcttctgtttcaaagctccagcctttccggtactccggccagctggaaatcatgatggattcctcttcttcctgaagattgcagaagatctcctcagtgaggaagggcatgtagggatggagaagctttaaggagttaatgagcacggtttttaacgtccagatggcagccgcctttgtcttatcctcatcatcccaaagccttggcttcaccatctcaatataccagtcgcagaattcctcccagataaaatcataaaccttttgaagggcaattcccagttcatacttatccaggttttccgtcacatcctttgtaagggtgtttaccttggacaggatccatttatccgcaagggtgagttctgaaagctctgccttagcatccggtgctttctcaatattcatcatgatgaaacgggaagcgttccatactttattggcaaagtttctgctggcctctacacgttcccagtagaaacgcatgtcattgccgggggcatttccggtgatcagagtcatacgcaaggcgtcggctccgtacttctcaataacctctaaaggatcgatgccgtttcctaaggatttgctcattttgcggccttcggaatctcttaccaggccatgcatcagcacggtatggaaaggaagctctcctgtgtgctcaattccggaaaataccatacggattacccagaagaaaataatatcatagcctgtaaccagcacatccgtgggatagaaatatcttaaatcctctgtttcctccggccagcctaaggtggagaaaggccagagagcagaggaaaaccaggtgtcaagggtatcctcatcctgggttaaatgggttcctccgcatttggggcatactgttggaacctcttttgatacgatgatctccccgcaccggtcacagtaataagccgggatgcggtgtccccaccaaagctgcctggaaatacaccagtcacggatgttttcaagccagtgaaggtagctcttatcaaatctctcaggaacgaatttcagttttccggtctttaaggcctcaatggccggctttgccatttcttccattttgacaaaccactgctgctttaccataggctctacggtagccttgcagcggtcatgggttcctaccgcatgggtatggggcgccaccttcaccaacagtcccagctcctcaagatcttttacaatggcttttctggcctcataacgctccatgccatgatatttactgccgggaagattaatggtggcatcgtcgttcatgatgttgatctctggaaggctgtgtctcttcccaacctcaaagtcatttgggtcatgggccggggtgatctttacacaaccggtaccgaattccttatccacataggaatcggctacaaccggtatttcgcggcctgtaagaggaagctccagcattttgccgatcaagtcctggtagcgctcatcctccggattgactgccacagcagtatctccaagaagggtctccggcctggtggtcgcaatctccacaaacctgccttcttctcctgcaatgggataattgatgtgccagaagaaaccgttctggtcctcatgctccacctcagcatcggaaatagaggtctggcataccgggcaccagtttataatacgggaacccttgtaaatatagcctttttcatagagccggataaacacctccagcacggcttcagaacagccttcatccatggtaaaacgctctctgtcccagtcagcggaggagcccatcttatgaagctggttgatgatccgtccgccgtattcctttctccagtcccagcatttttccaggaatccatccctgcccagatcttctttttcaatgccctgcttctttaagctctcaatgaccttgacttccgtggcaatggccgcatggtccgtgcctggctgccaaagggcctcatagccctgcatcctcttataacggatcagaatatcctgcatggtgttgtcaagggcatgccccatgtgaagctgtcccgtaatattgggcggcggcattacaatggtaaagggctttttatccttgttgggttttgcatgaaaatactttttatccagccatttctcataaagtttcccttcaatccctgccggattataggttttttccaattctttcattcattttctccttccaatttcccataaaaaaagccctctgcatccacaggatgcaaagggcgaatcaacgcggtaccacctttattcatatgacagattctgccatatatctcagagcctttaacgcagctgcgcgtgaaagcctaggtacatttctgtcatttcagccttccggttccgaagctaccttccgcatacacttccttaaccgtctttcagccggtggacggttttctctttcagggttataagcgtactcctcttcttctctaccttttccttattcctgcccatgcttttggggcatataggcatacccgcagggtgttttcttatttttacccatgattttggatcatagcgggatacccacggggtgttttcttatactttgtaatgatagtgtctttttacggatttgtcaagacataatattcctgtattcctgtttccatttctgaatcagctcaccggctccctggaaacgcttgatcgggtctttttgaaacagccgttccagctcctgaaggctgtcagcctcagctgccttgatttctgcattttctttttctctccggcattcctcttttaattcatcggtaatgagcgcctgaaaccgttcatttaacacaaggttgggattccactgggacagatgacatattttctttaacacttcgccgttttttaccagatcaaaggacttttgataggactggcaggccttgtccgtcataaacagtctggcataagctgctcccagattattatagactttagcccgaaaggcatcatccatcctgtctgcctttggaaggtcaagaagccggcagtattcggctgcagcctttccatactgctttcttgaaaacaggtaatctgcctttgcctttaaaaactccgaagcaggcatccggcggtaagaggctaagctctggcggaaccggctgacctggtcggcagtatagtagtcacattcatgaaggatcataacaagaagctcatccggctcctcgccgctttgctgccacttctccagcttggcagccagaaaaggcatatccaaatcctccctgataaactggattaagctgtcatccacaaattgatccaacaccagaagcggattgttatagatcgcataacaaagctcctgggaggaaaataaacggactcccaggccttcaaaataaaaaggatgtttgaccggctcctgccggcaaagaatcagactcatagcataacctcttgccttattacggcctccgtagccgggaacaattccccaaagcctttgtcttttagtaccactgccatggttttttcatccagaaatccaaagctgatccctacgcgcagggttctgtccgtccgcttaggaaatccttccagcggaattttgatcagccttttttgttttgggtccattggcgttaccatgaattccacataatcctgatgatccacgattagatccacgctgctctttgcctcataccagctgtctccggcagcagcaaccacaagctggctttcccgttccttgtggagcacccgcatggaaacggtggaatgaagccgcccctgacaaatgcaggtaaagggaaaagcggtcttctcctggagataatccattcctctaaaagccgcacccctggcaaacagctccggttccatatagaccttccggcgggagcagagtatcttcatagaatccgccgcccagtcgtgatgctcaaagccttttcccgtcaggaatacggaggaaaataatttcttctggagaagcctttccgcacaggagcttaagattttatccgcaagctttcccccggaaggtgtccccagaatatccagattaaagctttcctccaaagcctcattctccgcaatgaccaccatcttccgaaggcctctctgcaccttcagttcatgatagtggaaagcgtcctcagataagtcaaacacacccacctgattgctccaaacctcttttttctggctgagggcataatatacaaagctttccgtatggcttatgatgtgcacccgttctcttggaatctctaagtagtcggcgcagtacataagcgcatccatgagctttccatccaccttctgcatggtgatcaccagctgctttacctcttcgcagaagaactcttccatgggaagctttaatatcttttttaaaaacatctttaaaaggtcaagaccttcgtacttggtcccgcccagggtagcggttccttctttcctaaccatttttatcagcttgtccacaataatgccctcgcctacaagggtataggcaaaagcctcttcccctacaaaccaggcatcttcatcctttttcctgcagatgactgtaggaatgcaccatgattgttccctgtcatggcagcatatgcgggtataggcatcgcaaaggtcaagccctattatcagtccgtccattgacagcccccttatcttacatcagtggaaataattcttctgcagcagcattcttttttaaatactcctgcatccgttttttaagcccgttttcatcctttaagcttaaggaaaggcccatttcatttaagcaggcaaacctgctgtccgaagtctcccgggaggtcccggtctcgcagctgacactgccctcttttttcacgacccacgtttccccggtcagttctctcacctggtactccatgatctcgccttcaaacaatatcttctgcttgacaaaaacccctggtacatccgggaaatatcttcgctgtgaaattcctcttcatcaggaagtatcctcacctgaagctccactttggaatcacggtctgtgcagtactggatcatggccttgtccataatatcctcagacatggggacatatgtcgcaagagccttaaaatatgggaatacaaagccctcttccagaaggaaggaaaccgtattccggcacagcttttgctgctcctcgtcaagagcaggaagccgggaataatattttgttatggcaagcagataaatggtcggaagccggccttttaaagaagcggctttgaccgttccttccaggtaggcaaaaatcttttcctccggctccttatcctccataaaatactccgtacatttgatggtaaagtaagcctttacgatcatgtcgctggtttccttacggctccggtaaaggccaaacactttatccagctttaagctgcagccggaaaacatcatctgggccgtcaggcgctcttccagatcatatgtttccacatgttcggaaactcccttcataagcacgcgatacatctgatccgtgagaccgttaaaatgctcgcataaataatcaaggatcactccgtcactctttccttccctgaaaacatcgtaagccagatgcaaaagcaagggatcctcatcaaataaattcttaagtatcattttcgaacacagttcatatagccgttttgtctcaaggccttcactgccgaattcccggatcatcaaaaatgcctcttccatataatcattatggataagggtgttgcagacgcttatccgctcctgctttgtaaggacctttttgtccagcttaagcaggtatccggccccttctcctccttcttcccgggaagctgcctgctcctggtagaattcaatgaccctggaaagaaggagcttctgataaagagggcgcagttttttatcttctaacgtgccttctaaaatcttcacttcttccacagaagagactccgtctgccagaatccgttcacatgcccggagccggagcatggaatgctccggatatacttcaaaacagcgttcttccagttccggacggtccatgaccggctcttttttatacgaaatacctgcataccggttgccaaatgcatcctggaaaagcaatatgctgtgttccgaaaacagcggtacataagcaacgccgtcattaagaagaaaggcatcctcctctgtcatctcctcatagcatacaatgacatacttcatctttttattgctgcattccacccggtaagaccggagaatggagggcagcaccattgccatgggaaggtcgatcacatcctttagtatcatccgctcatagatcccggccagctgcttgtcgatccgtgattcaaacagctgctccgtggcaaacttttcaatggtacgttcataggcctggtaaagagggtcccctggctctaaatagaccagaacattcttataaaggactgccctactgtggagatccagctcatttcctccataggaaaaataaaggagcacttcctttggaagtaggtagcagtaatttcccggcaaagcgtacagataatattcatacagccgcgtcaggctgatcccggcctttatccccttttcgtaccaggaaaaggcttccgccatgcggcattcccctttgatcaacaaggcgcagatcgcctcaagcacttcttttattgggtgttcttcgtatagcttaaccagcatccggtaatggagccggttaaaatgttttgctgccagggtaagcctggatacggcaacagccagctttttatccacaagccccttgcctgcacagtgataaaggatctgaagctccatggcccccatggttctcatgacctccggcccatggtttaacaccctgcagccccagacatagaaaaacgggcttctgacgcccatatgaaactgttttttcatcatggaaagcagggccggcaaattttcaaacagtctgtcatccagttttatgagcagcaaaaaaagccagaaaagccgtctgtcttcttccagatattttttcatgagacggattaaggattctttctgatattcgtccggctgcacttttaagcgaaggaactggtaatagcagtaaagctcccttttttcctggcggtcctttaggatttcatccctgcactcatcaaggagcagggcagccttggaaggatttccctgtccaagaaatatttcagcccggaacagcttaagaaggccgctttcacccttcatcaattcgatctcatcaagggcccttcccatctcatcatataaaatattcaaatccttttgcccgtactcttcttccaggcgaagcttaagaaaccggccaaaggcttcctttgcaaaagcgtcttccgcaggtatgccgccgcccggattattgaccgccgttacggggatgacaaaacggtcctcgatcccggttatcaaaatccttccggagttctctccctggtgcatgcgctccggatgaaccaggaacggcaccctgcattcctcttcttcaaaatcctgttccccaagatttttcttgggcagctctataaaatcacagtccgttgtaacttccaggttcacatacccccagtcactgcgtgttatgaccacccagtccgttacaacctcttccaactctccaaatctccgttcctgggtttccgcccatagctggaccggttttttcacctttaaagcggtcagaaactcttccagttcctttcttctgtcaggccgtccctttaacccgtcgtaaattgcccttacacgaaggtcctgcataaaggtagccgtggcaaaatcccggtactcgaacaaacgaagtgccgtgtccatatctttttttgctgtttctgcaaaatcctctgctgtctttaaatcgctcagtgcttttcctgacgtactcagttccacacaaaaagaataagggacttctctctcgccgccattggtaaccagataaaaagagcccttaatcacatctccatcttccagaaaactgctgtttatctcatagaccagatggttatatgttccgccaaacgctccgcttatgagtttgacacggaagttagacgaatatgcaagtccttttatatgcagattattctcactggtgacgacaagctcccgcctggtagccccgcctgaacgcaccacatcatcaatttcccctggtgtaaccttaatctttggaatctctgaatcaatgatgccctttgccagcctgttgatccgttctctcatagtaccacctgtatctttaacatccttatcttattagcttgtttgaattcaattactctatatataaaaacaaaaagactgttttcataatcggatggacggggcaaagaacgccccttttatccccacttgcgctgcaagttcggataagttatattatgaaaacaaaagatgttttcataatcggatggacgggctgaaaacagcccttttatcctcacttgccttgcaagttcggataagttatattctaacataatttctattgatttaaaaccctaaaattggtatgataaaataaaactgtgaaaaaaaggacaaacgatcatgacaaccaacgaaaaagctttattgctgcatgaagaatggaagggaaagctggaaatcacttccaaagcaaaggtaaaaagcagggaggatttagcccttgcttacaccccgggcgtagcggaaccttgtaaggttattgctgaaaatccggaggccgcctatcaatatacgatcaaatccaacaccattgccgtggtatcagatggcagcgctgttcttgggcttggcaacatcggaccgttggccgccatgccggttatggaggggaaagcggtgctgtttaaggagttcggaggaatcaacgccatccccatctgtctggatacccaggacacggaagaaattattaagactgtggtaaatatcgctccggcttttggcgggatcaatttagaggacatctctgctccccgctgttttgagatcgaagaacggttaaaagagcttcttgacatccccgtattccacgacgatcagcatggaacggcgattgtggttcttgccgggatcataaacgccttaaaggtgaccggaaagacaaaagaggaatgcaaggtagttgtaaatggtgcaggctccgccgggatcgccattacaaagctccttcttacctatggattcccccacatcaccatgtgcgaccgtgcgggaatcctggcaaagggcatggaagggctaaactggatgcaggagaaaatgatggatgtgacaaatctggaaggaaaacaaggttctctggcagacgccatgaaaggcaccgatatttttgtaggagtatctgctccgggaattgttacagaagaaatggtcgcttccatgaatcccgatgccatcctgtttgccatggcaaacccggttccggaaattatgcctgatcttgcaaaagccgccggagcaaaggtggttggaaccggaagatcggatttccccaaccaggtcaataatgtggtagtgttccctggaatcttcaaaggcgcattggaaggccgggctgcctccatcacggaagaaatgaagcttgctgctgcagccgccatcgctgaccttgtagcgcctttggaactgaacgaaaataatatcctgccggaagcctttgatccccgcgttgctgctgctgtaagcctggcagtcaaaagtaatatccggcagtagaaaacataaaagatccggttgaaatctgctttcaccacccctgattttacggcgcagccagcgcattactggagataaacccctgcggggatatcctggaaagaggtgaccccttacagggaggcctgcatgcccaagcagcgcggacaagaaagaggtaatcccttagggacgcctgtatgcccaaacagcacggcaggaaaggtagccccttaagggatacctgtatgcccaaaaagcatgggcaggaaagaggtagccccttacagggatacctgtatgcccaaaaagcatgggcaggaaagaggtaactatgctgtcggaacccatgaccctgtacaaactgatgattttatacatgcttaaacaggttaatttccccctgacaagcgcacagctgtcaaacttttttctggagcatgaatataccacatattttacgctcaaccaggcattaaatgaactgctggaggccagacttcttcttgtggaaaccaaccataacagcagccggtacgagattaccagggaaggggaggaaaccctttcctttttcggtaacaaaatttcccctgccatcatcaatgacatggatgaatatttaaaggaaaacaagttccggctccgcaatgaagtcggagtaaccgctgatttctataaatccaccagccatgactacatcgtccactgccaggtccgggagggaaaaaactgcctgatcaacctggaactgtctgttcccgacaaagatcaggcagaaattatgtgtgaccactggaaatcaaaaagccaggaaatttatgcatttgccatgaaagcgctgatgagcggttcttaatttttcatccaacagtaaacaaaaggggattcatcttgaataaaattcagacaaaaaaaccattgttttcggaaataagccagcaatatcggtttcaactgaagaaatttaagaaaaagaagttctattttaaggcaaagctgattttaaccgtcatccttcctgttcttatccttgtgctttccgtcaaaacggcagaaacctttatccggatcaagctgcggaacctttttgccaagccggtaccttccagtgcgcctgaaagaacgggtgaaccggtttctatccatgcagttccggctgaggtggagattttgcatctgcaaaaggtttccgaggattcttaatttacatccatcgcgattccgggcagtcaatgcattcttacaagccagaaaagaggaataataaaaaatggttatccttgattttacccgtgaacatatcataaaggcgagcgaacttgcacttgcctgctacgaagaagaatgctctttggtaccggcattgccaaatgcagatcaatttcctgatttgacttattttgccgataatggtctgggtgttgcagcgtttgaaaatgggaagatggtaggatttctctgcagcaccgctccctttgacaatgcattttgttctaccgatgccaagggcgtgttttcacccatggggccaatgggacaacacgggaaaacaaagcaaagatttacgctgccatgtatcaggaagctgcccgcaagtgggtaagagcaggtgctgtcagccatggtatatgcttatatgcacatgacgaaattgcacagcatcaatttttcaaatatggttttggtctgcgctgtgtcgattccattcgccctatggagccatttcactgcgccccctgtgaagaatacaatttttcagaacttgaagccagtgagtatccgaccgcatattcattggaaatcatgatgcatgaacactatatcaatagtcccttttttatgaaccgcaaacctgatgcacgggaaatattttgcgaaacatgcgtcagggatcatgaacgatgttttgtggctcaatatggggacgaaacatgcgcttatttaaagatatcggaaagcggagagacttttatttcggaaaatccaaactaccttcatatcaccggtgctttttgtctgaaagaacaccggggaaaaggagtatatcaaaatcttctgaatcatgttattaagatattaaaagcagagggttacacccaccttggagtagactttgaaagcatcaatccagcagcatatggcttctggtcaaaatactttacggcatatactcacggcgttgttcgccgtattgatgaaaaaatattggcattgtctccctgtgaggcatgtgacatcttataatcgtaaataaaaagctgatccagtgaacccactgaatcagcttttattatccctgcatgaacctgtttaaaaattcctttgttgaattcttctttgggttgccgaatatatcagccggcgcaccttcctcttcgatgacgccgcctgccatataaaccacacggctggacacatccctggcaaatgccatttcatgggtcacgatgatcatggtaagaccttccttggccagagtcctcataaccgccagaacctctcctaccatctgaggatccagagcagaggtcggctcatcaaacagcaggatttccggctccatggccagggcccttgcaatggccactctctgcttctgcccgccggaaagctgccttggctttgcattgatgtaaggagccatgcctactttctccaaaaacatcatggctttctttttagcctcttccttatcctttttaagaaccttcacctgtcctaccaggcaattttccaaaacagtcatgttattaaacaaattaaagctctggaataccatgcccaccttggtacggtatgaggggacattcatcttccggtccgtaatgtccacatcatgatacaggatctcaccggtagtgggagtctccagcaggttgatgcagcgtagcagcgttgactttccggaaccggaggctccgatgatgcaggtcacatctcctgcattgacagaaaagtcaatgtcccgcagcaccacatttgtcccaaaggtcttgcttaaatgatgaatctctaatactttttggcctgtcatttatttatcctccttctctttgggatctggaaattttaccattccgctggtataagccagggtatccgtggtcgccaaatcgtagctgtccggaccatccatcttcttctcccagtaacgcaggattctggagcaggtaaaggtcaggataaaataaatgatcatggtaatgccgaatgcttcaaagtaagtataatacgcgcccgcaacgccttttgtggcatagaacaattccaccactccaatgacggaaagcacgcaggtatctttaatgttgatgatcaggttattgccgatctgaggcatgatattgcgcagggcctgaggcattatgacattgaccatggtctgaaaatgggtcatgccgatggccttggctccttcggtctggcccgggtcaatggaaaggattcctcccctcacagtctcagccatataagcgcctgtattaatggatacaatgaaataggcagcaaaaacaatggacatgttaatgccaaacagtacggaagagccgtagaatataaacatggcctgaaccatcataggtgttccgcggaatacctctacatagatattcaagatgattttcactaactttaataaaaacttttttaccggattatcacttttctgtaccggaatcgtctggataattcctacggcaaaaccgatgatacagccgatgaatgtgccgacaatggcaattgccattgtttttccagccccgtttaaaaaggaagggccataatgttgcagtataaacacaattcttccaaaaaaatctgatggcaaagacatatactaccttctccttttcgtaacttcgtttaaacagaacaaacggcacgaaataagaacgttcttgttccgtgcctgcaagccctgattctattctttattccttcaagcaaagccaggcaaaggaatacttacatttctgaaaccggccagtgcccaaggggacagctcccctcacctgcagcctgctgcagaatatctaacctggattaatttgataatggctgtacggaaatagcttcttccatcatcttgttaaagtcatcctcgttcattttagaaagtaccccgtttatggcatcctttaattccgtatttcccttcttcagtgagatgccgatgttcacatcttcatcagaaactttaaattcaccttctgttccggtgaaatcaagaagcttgaaatcaggataagcaaccagggctgcctgtccggtaggcttgtccgttacaaccagatcgcatctgccggagcttaacgccaccagcatggccggtgcggattcctgggcaggctgaacgtctgcatcgggaatctgaggcagacagttgtcataccagatggtatttaactgagaagtgcaggtcgcaccggaaagatcggcaacactctttgcattctcatacttgcctcctgcttttaccagggtcactatggttgcgtaataataaggatccgtaaaatcaacggactgggcacgttctgcggtaatggactgtcctgcaatgacacagtcaacctttccggactgaactgcaggaacaagggaatcccagtccagctttacgatctccagtccatagcccagttcttccgcaaccttcttagccatcatgacatcatagccataagcgaaatcagagctgccggaaattggaacggctccgttggcatctgtaggctgggtccagttgtagggcgcgtagctgcactccatggcaacctttaacacctttttatctcctgtttccttaccatctgccgcagatgtgcctgttgcggcattaccgcctccacaggcggtcagaaaggacgctgccagggctgttgccataagagttgatacgatttttctcattgtctttttcataactgttttctcctcttcctaccataatgaactctatgtaataaataggttcattataaaaagattttcactccttgtcaagactatttacagattctgaaatcatctcccaaatttcttccctgccctgcttcgtttcagcggaaaagggaatgaccgtcacatcgcttccgatcccaagcccctgacgaagaatttttaccgatttctgtatctggctccgcttgatcttgtccagcttggtggcaatgatcacgggctggtaaccgttgtacacgatccaattatacatggtcttatcattctcagaaggctcatggcggatatcaataagcagaaacacacaccggagcatgggtgagttgtggagatagttttctatcattttcccccattttgcttttacttcctgcgctaccttggcataaccatagccagggaggtccacatagtaaaaggcatcgttgatgttataaaaattaattgtctgggtctttcccggctgggacgagattctggcaaaggacttgcggttcatcagggcattgatgagagaagattttcccacattggacttgcctgcaaaagcaaactccggctttgtgttttccggaagcttgctggtgattccgcatacagtctccagctctacagttttaatgatcatgtgctttcctctttcctgcccatgctttctgggcataaaggtatccctgtaaggggtttcctctttcctgcccatgctttctgggcataatgaaatgtctgcaaagcctgcagggcatctctaatcctgtacaaaagcttcctttaagacctgggacatatttttcgcataaacgatttcaaggccgcctgtgatctcctctgacagctctgcaatatccgggcggtttctgtcaggaaccagaaccttctccacatgagccatgcgggcagccagaatcttctccttaaggccgccgatgggcagaacacggccgcggagtgtgatctcccctgtcatggccaccttggcgtttactttccggtttgtaactgccgacagcatggccgttgccatggtgattcctgccgacgggccatcctttggcactgccccttccgggatgtgaagatggatatcgtgcttttcaaaataatcattctttatcttaaattcaggacacacagacctgacataacttaaagcggtctgggcggattccttcatcacatcgcccatctgtccggtcatctgaagggttccttttccaggcataacattgacttcgatttgaagggtgttgccgccgacgctggtccatgcaagccctcttacgatccccacctggtcttcctcgttcacatcctcaaaaagcactttttccttacccagatacttttccaagttgtcttccgtgatttttatagcccgcttttcatcttccaggaattctcttgcagcttttctgaaaacagccccgatccgcctttctaggtttctgactccggcttctctggtataatggtgaatgatcttttcaagagcttcatcggatatggacacttgcttctctgtaagcccattcttatcccgctgctttcttactaagtaattctttgcaatatgaaatttttcattctccgtatagctgttaacttcaattacttccattcggtctaaaagaggccccggtatggtagtcgtggtgttggctgttgcaagaaacagcacattggataaatcaatgggaatctctacatagtggtcccggaattttacattctgctcactgtccagcacctctaaaagagctgaagaggtatctcctttataatccctgctcactttgtcgatctcatcaagaagcatcaggggattgctgactccggcctgtcttaaggcctccacgatcctgccgggcatggctcccacataggttttcctgtgtccgcggatttccgcttcatcccggattccgcccaggctgatccttacatactccttgtttagagcctttgccacggacctggcaatggaagtctttcctgttccgggcggtcctaccagacagattatgggactggacccttttttcgtgagcacacggactgccagatattccaaaatccgttcctttaccttttcaagaccataatgatcctcatttaaaatttcctccgcatggacaatgctgttattatccttggacagctttttccatggaagctccagagctgtttcaagatacatgcggaccacatttgcctcctggcttcctccaggcatggccttaaagcggtcaatttccttctggatcttatcttttgtctctttatccgcttttaaaaccttcagcctttttacgtattcatccgcatcggacagagggttgtcctctcccagttcttcccggatcacctttaactgctctcttaagatataatccttctggttcttgtcgattcgttccttcacatgggactgtaattcccgttttacctttgttacttcgatctccgttatgagctgcttcatgaccagcgcataccggtcctctaaaagagcgctttcaagcacctgctggcgtacccggtaatcccaggaaagctgtacggcgatctggtctaaaagctcgccaaggtcagaaagcaccagaagattgggaagtacctcctttgcaatccggggattctccttgccgtattcctccagcttttcctgaatgatctgtatcatggcctgtatggcaatgtaatcaagggaatcatctgattccagggttctttccacttctcctatgagcatgggttcctcgttgtcaagagccagaagttccacccgctctacgccttccaccataacacggatcacattattgggcagctttaccagctgcttgacaagagccactgtacccacctgatataaatcttcgattccaggatcagcttcctcagaatttctctgggtaaccagacataccttctggtctcccaccattgccttctccacagccgcaatggactttgtccggctgatgtcaaaatgcagcatcattttgggaagaacagtcatgccacgcagggcgataactggcattgtgattatcttatccaccattgtgttctctcctttgcattcaaaaaggtgttccagcagattctctcgctgtaacaccttcccgactcatgcagggacctatgcgatctcgcctgtcttatcttttcttaacttctgagccagtgattttctggggactgccgtgtcccgatagatcagctccggctcaccctttttatctacaacatccttggtaatcgtacagattccaatgctgctgtcagatggaatctcatacatcagttccatcattacgctttccataatggaacgcaagcctctggcaccggtctttctctccactgccagctctgcaatccgctctaccgcgtctctggtcagctcaagctttacgtcatccagttcaaacagcttttgatactgtttaaccagggcattctttggttctgttaaaatcttcacaagcgcttccctgtccagaagttccagggacacggtgatcggcacacggccgataaactccgggatcaatccgaacttcaccagatcctgaggaagggtctttttcaaaagatcgtcaatatccgtcttgttcttatccacgatttctgcattaaagccgatggaaccggcgcttaaacggcgttcaatgatcttttccaacccgtcaaaggcaccgccgcagataaagagaatattggtggtattgatctgcagaagctcctggtggggatgctttcttcctccctgaggcggaacgctggcaaccgtgccttccaggatctttaacagagcctgctgtacaccttcaccggaaacatccctggtaatggatacattctcagacttctttgttattttatcaatttcatcgatgtagataattccatattctgccctgctgatatcgtaatcagccgcctggatgagctttaaaaggatgttctccacatcctcgcccacgtacccggcttctgtaagggctgtggcatctgcaatggcaaacggtacatttaagacctttgccagcgtctgcgcaaggtaggttttaccggatccggtaggacccaacatcagaatattgctcttttgcacatccacatccatcttttttctggaagtgattctcttatagtggttatagactgctacagacaataccttttttgcgttatcctgaccaatgacataatcatctaaaaatgtcttgatttcctttggcttcatcaggttaatatcgccaaaatcaggtccttcttcctcatggctgtcgaattcttcctccaatatctctgcacacaaatctatacattcgtcacagatatagacattattggaaccggcaatgagtttcttcacctgatcctgggtctttccgcaaaaagagcatcggatcttgtcgtctgttctaaccggcatatacacacctcattctttcctaattcttgcccgcgccctctgggcaggtcccaccccgctccatcgggcgtaaagggctaccgcaggatgtttcccgtcagccgccctgcttttccaggtacaaagacttatcggtcatggctgtagatgatatcatcaatcaagccatatgcttttgcctcttccgcattcatataattatcacgctcagtatccctttcgattacctcatagggctgacccgtgtttgcggaaaggatttcatttaaccgtttctttatcttcagtatattctcagctacgatccggatttcggtagcctggccctttgctccgccggaaggctgatgaatcatgacttccgcattaggaagggcaaaccgttttccctttgctccgcctgccagtaaaaatgctcccatgctggctgccatacccatacaaacagtggatacatcgcatttaatgtaattcatggtatcataaattgccatgcctgctgtaacagaaccgcctggactgtttatataaaggttaatatccttgttaggatcttctgcctctaaaaataacagctgggccacaacaaggcttgctgatacatcagacacctcttccccaaggaaaatgatcctctccttgagaagtctggaataaatatcgtaagaacgttcgcccttactggttgattcaatgacataaggtactaaactcatctgtcttcctcctgtctgttctttcctgactttcctaaaaccgcccgtgtcatccgggcttgatccgctccgttttgccgggcggaaagggataccggtaagtatctcttatcaaagccgaatagactccggacaaaaatgccaggaatctattcaggtcaaacttcttaaactaattttgcttcagcaaccagaaaatctaccgcttcctgaactgccagatcttccttcatctgctggataccgctctcgccaagagattcttttaccagagaggcctccatcttgtaagcttctgccatgctggcgatctctttctcaaccgcttcgtcagaagcagtgatgttctccgcctttacaacagcttccagtaccagtcttgtctggattctcttaatagcctgaggcttcatctgctcttttaaggactggagtgtcatacctgtaaatttcatatactggtcaagagacaggccctggctctgcattcttcttgcataatcattgaccatgttgttaacctggctgtcgatcatcggctcaggaatgtccatgacagaattttcaacgaccttttctaccacacggtcttcgttctctgttgccgctgctttctctttgtttaaagaaaccttttcgctgatgtctttcttgtactcttctaatgtctcaaattcggaaacttcacttgcaaactcatcgtttaactcaggaagttctttcctcttgatttcctttaccgtcaccttaaataaagccggctttcctgccagatctgttgcatgatattcattcgggaaggttacgttgatttcgcactcttcgccgatgctcttgccgatcagctgttcttcaaaggtatcgataaaggagtgggaaccaatggtaagaggatagtcctcacccttaccgccttcaaatgcctttccgtctacaaagccttcaaaatcgataaccgtctgatcgccatcttcaacagctctgtcctcaacggtgatcagtctggaattctgctcctgaactttctttaattcagcatcaatatcttcctcagtcacttcggcagatgccttagtcacttcaattcccttatactcgcccagggttacttccggcttaacagcaacagtcgctgtatagatcagggtcttccccttctctacctgtacgatatcaatttcaggtctggaaacgatatccagtccgctttcttccgctgcgccgccatatgttgcatcaagagcctcatttactgcgtcctcatataaaacgcctgctccgtacatcttctcaatcatggcctgaggagctttccctttcctgaaaccagggatgttgaatctgcccttattcttattgtaagctgcggtaagagccttatcaaactcctccgctgacacttctaccgttaattttgccatgttcttttctaatttttctacttgtaaactcattaaagggttcctccttgaaatatatgtgaaccgccaaatcaacagggcgttacacttcaatttagcattataacatactcgtcccgtaaattccagtactatttacgattaaatcaggtttttcctgaaaactcctgcattcgtttcacaatgtaggggtcaagaggtctgatctccatttgcggcctggcaatatagtatccctggaacagggaaaccccgcaatccatgagaaattccagctcttccggagtttccacaccctctgccagaaccttggtgtcattttgttttgcatagtccaaaaggttccttaaaataatctggcggttgggatcttcgtggatccgttttaccagattgatatccaccttaatgatgtccggcctcatgcgaaggagaatagtctcgctgttataccctgtgccgaaatcatcaatagccacctgccccttccactgtctggccatatcgatcttacgctccatgaaatcatggctcgccggttctccttccgtcatttcaatgacgatccggtgaagcagctctccatagctttcttccagctcggcctgctcttcttccgtcaaacagacgctggcaatagaatttataaacagcttttcatcaggtcccagctggccggcctctatctccgccataacggctctaaggcctgcaaaccaggtgagcgtttccatctgaggaagctttgcctgggcccttgccagatttaagacctcgctgatccccttcatatttacaaaatccggacgcatcagcagctcatatccgtatatctctccatcccttgatgcaattggctgaaaggcaaaacgaacttcttttttatccagcatccggttaagctcctcgctgccggcaagcatataggaattatgggtatactccttaagatcaaactcctttacgataccctttacgctgtgctttaccatgtacatggcaaaatccgcataattaaacagcgtttcaaagtccccggcatcatccggataccaggaaagccctcctgatacgcggatgggaaaccggtatccttcttctgtgtttaagctgaatttttgaatgtgtttcatgaattcccggacttttttcctgatttcatccttttcatccgcttccagaaaggtgacaaattcatctcctgaatatctggcgacaattcctcctctttctgaaaatatctttaagcagccggcaaacaagacaatgtaccggtcgccttcgtcgtgtccgtacgtatcgttaatatattttaaattatccagatcccacatcacaagtgcggagaacttctttttctgcttcttgattgcagcctccacctgctcccggaatgccctccggttgtagagatctgtcagcaggtcataatttctttccctctccagtttttccttctctactacgtccgcagtcacatccgagcacacacctaaaatcgtcccttttttggattcatccagaataaattctacccacctggtcccctccggactttccaggcactgaaagatacggtccccttttattttaattccggtaaaggtccgttccatgtattttttgaatttttccgtttttatataacagtagggttcctccaaatgaccccagcccagcatctcaaacaaagaccggctgcagaatacacgctccccctcctcctcgtattcaaatacgccgatggggatattggcatgctccagaatgctggaaatctttgacgatgccctctccacatcctggtttaattgttcaatggtttccgtcagttcatcgatttccctgatatgtactctcttaagtgaaagccccctgcttcccgacttgcctcttaactccgcaaccagtctgcggatgggttctgtcataattttccctatgacaaacgctcctaacaggctgaatataagaggcaccaccatggagctcaaaagcatgcgccgtatggcattataaaaggaaagcagatccttttggcgtgcaatacctgccaatacccactcttctttttcaaagggactgttatttccatagacatcaaggcttcttatgctggcataccatctggtcccttccgaagacctcagctggctgatgttctcttcctcattatcctcataattgatccttggtctttcattaaaatactggttatacaggtatccggaataggctacaggcacaatggtccttgtctccttgttcctgatgcccaaaagccagcactcctcaaagctgccgtttgtctggtcatctccaaggatctgttccagctggtttaacgtcatttccagcccatacactcccgcaatggtgccgtcctcaagaataattggaatggaataggttatgaccggcatatccctggggcttaaacggaaaggagggcttaagtaggcgaatttcatgaaatcctccggtgccgcctgattctgcactgccatgagatatggctttttataaaaagtggaggctttgctgtcctcgctttcctgaaaaccaagctcccaaaaggaatccaagggaatatcatacttttctgctatggatggcagccctctttccatcaggagagaagaattatcttttaagtatcctcctgagttggaattcctcacgtaaaagcccgctttcatttcaaccggactgtttttggccgccgggccgtttaagaccataaaaacccccgtagcgtggctcaaatgtagcatttctatggacttttccatgatcttatcaacgattttcctgttcagcacataatccgtagaaatatccccggaacggcgcttctcttcatccagcacctgctggataccggcagtaatgaaatcggaattattaaacatgacgacccaatggtgaaaggtttccttttccaggcccagctttgtgttttccgtattttcacttaatatatggatttcattattttttaatttaatagaaactccgccaaacagcaccagtcccgcaatgaccgccgcctgcaggaccagaaggatgagcaatggccccagcagctgggtgcgaatggattcacttctcttatttttcataaattgtaccctaaggaatgcgtttttctttcaaccttattctccgacaatcgcttccaactgccccatcgtatccctgtaccagttatcaaaattctcctctgtcaaaaaatttgcaactgcattttctctcttaactccctgacccatgagagtgcatacctcattgtaatcttcctttgcctttaaagccattgtggaattcagcacgcctctggcacggtcgcctcctttaaaaggttttgaggtgtaaagcctgtactgattggccgtatcaaggccgatcaaaagattctgtgatacggtgctgttttcaccggcttccgccaggaagggcttcagcagttcctggttcccggccgctttcttaaccggaagataaccggagccaacggcaaattccatgttatgttccacactggtaaaccattttaagaaaagggttgccgcatactcccgcttttcctcagatttaaacaccatcataccggccccctgctgaacggcacaggacacggctccctcaaaattgggcaaagggtagagcttgctttctatggcgtagttggtcccatcttcaagtgtcactgaggtaggaaaataagcaattccgctggtggccccgacaaatgccgccagctggcctgtcttcacatcatcactccggaattttccataggacccaaagtatccgttcacatagggaacataatagttatcccacagcttccgcatagtctgcctgtcaaaatccagaatggtttttccatcctttaccttaaaaatctcatggccaagctgaaagctgccgatgatcatataattggcaaaggcatcccttccaaaaaaggcttttccgtcatccggcgtctctgttaggctgtccgtccatttataatagatctccgccacccgggtgatcccttcccaggtggaaagtgcttcctccgtcacgcccgttgcctctgcaaacttatcccagtccgtcttgttcacagtgaggatctcggtggattttgctataggaaacaccttgatggcccctgtgctgtcaaacctgccttcttctatgtaagcatccacatattccgataattcctcagaagtcagatagttgcttaaatccgccgccaaacccatctgatccacttcgtacactttatccacgtaggcggaaaatacgtcaggcagaggctctgatccgatcttcttttcaatgctgtcattgaccagagcgcttaactcgtcaatacttcccttgttaaatgccttgacaatgatccccgttcctcgtccttcgctttcattgaattcctgcaccaggcggtcaaattcttccttctgaacaccattgtaataatgccagatggtaatggtgaccggatccttttctgacagtccatatggatttttcttatcacagccggaaagcaggctgatgaaagcagccgccatgaccggcaatatccatttctttttcatacgctcacctgccccattaaacagaaatatggtcgtactggattgcctcctttatctggcgggcaagtttttcatccgtcataagggcaagaagctcgattcccatatccagcgcatagcccagtcccctggcggtggttatatttccatcggtaacaaccccctgttttgtgtacacggctccctttagctctggttcaaagccgggaaaacaggttgcctttttcccttccaaaattccaagatttcctaaaatgcttggagccgcacagatggcccctattctcctgttctctctattggcttcctttaacgcatttaacagccctgtatgggcccccaaattcctggtcccaggcattccgccgggcagaaacagaacatcggcatccttgcagtttacttccgagaattcaaaatccgcctggatctttatctgatgggcacttattacatcccgttttccggtgacggaaacaagggacacctcctggcctcccctttttaaaatatccacaactgccaataactccacttcctctgatccgtcagctaaaaacgcatatacttttcccattttaatcctctccttttagcgtatgaaaggtactgattgcagtgaccttgatataatccaccagataccgtacgtccacatcttccccgtcaatcattttcatcagagtatcagcggcagtccgggattgtccctcatgatcatttaaaacagtgccggttatttttccctctttaatatactttaccgtgtcctgaagggcatccacccccaccaggtaaatatccttaccaggcacacgtcccgcctcttccacggcttccagggcaccgtttgccatggaatcattgttgcagaagatcacctctatccggcttccgtaagaagccagcgcctcctgtgccagctttttgccttcatccttgttccagtttccattgccggaaaacagttctttcgttttcatccctccttcttccagggctttaatggaatactccgtccggtaacggctgtcctcattgccttcctcccccaccagcatggcataggacaccactccatcaccgtttaaatcccccttatcaggcgtttctaaaataatttctccctgataggttccagcctgcctggaatctgttccaatgcaagacactgccatgtgcttgtcctgccaccgtttctgttcctcttcttttggctcccggttaataaaaaccaatggaatccctgccttgctgcaggcgtctgcaagctctcctgcagccgtcatctctactggatttataatgatcccgtcgcagccgtctgtaataaactgatccacctgcttgtcctgctctttctggtctccaccggcattgcgcatgactacctccgcatggtaggtttcttccagatactgcttcagctccagacggtacagcttcatgaacgtatcgtcatagcggtatatgctcaccccgatcttagggcctgttttctcaggtaccccttctgtgcctgcttccgatgccgagctttccctggcactggtttcttttatctcctcccggggagcgcagccataaagagggaaagcggtccagacgatcagaaaaaacaaaaaaatcccttcacttaaccgtttcatatccttgatctcctgaattacactgtttttcccatattaccacgttttgccttatttgtatactaatgaatcaagcagatacccgccttctactttttgttctcatgtggtatactggcaaaataggacagcgcattacatctgacagcgcaaaacattgaatcaggaggactttcccatggaaatagaacgcaaatatctcatttcccggccgccggccggttacaccgcctatccccatcatttcatagagcaggggtatctctctacagagcctgtggtccgcatccgcagagaagatgataccttctaccttacctacaaatcaaaggggcttttagaacgggaggaatacaatcttcctttgacccaggaatcctatgagcacctgatcaaaaaagcggacggccacatcctcacgaaaaaacggtacttaattcctctgaaaggctccggtcaccttaccatagaactggatgtctttgaaggacgctttcaaggacttatgctggccgaagtggaattccctgacagagaagaagcagaaaactttatcccgccctcctggttcggggaagatgtaacgttttcaggagaatatcaaaacagccggctgagcagacttccatagctcttataaataaagcgggccgcaggagtccaaaaggataccttttcccagactctcggggcccgcctattcatttctttccatttaagaaacggatatggccatcacacagaaaaggaaccggaacaagagcggaattttgctaaagcctccgctgcctttgctccggttccttttttcaaaaaccccggccaaaagccgcagggcacttcttaaagaaactacttctttgcaatatattttctgatatccagagcaatcgcaactacaataacgattccctgtgcaatatactgatagttggtatcaacgcccaggtactgcagacaagtctttaagatttcaaataccaggactccgatgagaacgccggacaccttaccaataccgccgtttacagaaacgcctccaatggtacatgctgcaatggcttccagctcccagcccattcccatgttaactgaggaaccgccggacttcgcacctacaaggaagcctcccaatgcataaagggctgctgctgttacataaatgatgatttttgttttcttcgtattaacgccggacacctctgctgcctgctcgtttccgccgatggcgtacatgtatttgccgtgaggtgtcttgttataaacaaaccagatcacaagcccaatagcaagggcaattaaaaataagtaaggaatcacattaaaaagcctgccctttgccacctccgtataagccgcgcggtaacctccgataggggttgcattggtataaacaaggcatacgccgtaaacgatcagctgcatgcccagagttccgataaaggccggaacctgaaggaaagaaaccaccataccgttgatcagaccaaaaattgcgcagacggcgatacagattaacagtacaacgaatacccaccagataccgaagtcaggaagatttgggaagaattttccgctgtatcccggtttctgaagcaaagtaccagcaagacaggccgaaagtcctaccatacgtccggcagaaaggtcggtacctcttgtaatcagacagccggatacgccgcaggcaatgatgaaacggggcgccacgttcaaggcaatgttttttaagttatcaggtgagccaaaagtcggctgcttaattgcggtaaagattgccagcatgatgagaacaacgatgattccattattgataaggaaatcttttatattaaccttttttgtctgcataggtaaatcttttgcattaattttctttgctgtcatgatttaacctcctgtgtgaaatttgctgtaacattatcgtttaaatcaaatttagtggcaaatgccataattttttcctgagttgcctcttcatcttccagttctccggtaatatggccgttgcacataacgataatccggtttgacatgccgatcagctccggcatttcggaagaaatcatgataattgatttcccttgttttacaagttcaatcatgatctggtaaatctcatattttgcacccacgtcaattcctctggtaggttcatccatgatcaggatatccgggttattagccagccatctggcaatgatcaccttttgctggtttcctcctgacagagattgtatcagggtcctgtcattgggtgtcttgatactcagctttgcaatgctgttctttactacctgccccacctttttgctgttgatggttcctgctttggtataattccggtaagaggcaatggctgtgttatcagcaatgctcaggcagccgaaaataccggtcccccgtctgtcttccgtaatcattcccacggagtcagcaatcgcatcctggggacgtttgacagtcacctttttacccaggatctcgatctccccgcttgcaatgtgacgcattccaaagatggcttccatcagctctgttctctgggcacctaccagacctccgaatccaaggatctcccctctctttaattcaaaggagcagtcctggaaggaacgacggtggatgctgcttacatggcttacttttaaaacggtttcatctgtccggcagtcttccttaggcggatagacgttactcaattcccggcctaccatctgctttacgatctcatcatccgaaatgtcctttacctcccaggagcctacgtatgttccgtcacgcatgatcgtaatgtcatcggcaatctgccggatctctgccatcttatggctgatatatatcatggaaacaccccgggcctttaaatccctgataatgcgaaacagtgcttccacttcattatcagtcagcgatgaggtcggttcatccaaaattaccagctttgcattctggctcactgcctttgcaatttccactgactgcatttgtccgattgaaagtgtcccaagctttgccctgggattaaaactcatttttacatcatttaaccatttttccgcttcctggttcatggtcttatggtcaactatttttaaaggacctatttttattaaaggatatctgccaaggtacatattttcagcaatggaacgcgccggaaccggctgcagctcctgatgcaccatggcaagccctttgtgaagggcatcgtccggatttgcgatgctcacatcactcccgtctataagaacctttccttcatccattttgtaaatgccgaaaaggcatttcataagggtcgatttacctgctccgttctcacccatcaaggcgtgaacggtaccgggacgtacttttaagttgattctatcgagcgctttaacgccagggaaggatttgctgacccctatcatttccagtctgtacttctctgccatcccgtttctcctttccgatttattgcccacgttttctgggcataaaggtatacctgtaaggtgtttccgatttattgcccacgttttccgggcataaaggtatacctgtaaggtgtttccgatttattgcccacgttttccgggcataaaggtatacctgtaaggtgtttccgatttattgcccacgttttccgggcataaaggtatacctgtaaggtgtatctgatattattgcccacatttctgcaggcattaatccacacctataaggtatttcaactgcaattatctccgtatacttttaaaaatcgggtgtgccttaccgacacacccgttttttttaccggctgttggaaattattttaacttatcaagaatttcctgtgcattatccttggtaactttgatatagtctaccatatttacattatcaactgcttcaccctttatgaacttaacagccatatcgcctgctgcgtgagcctgtgagaagtgatcgttgaatacggtacctgtctgtttgtcttcgataacattctgaacagcctctgtcagagcatcaacacctactaaatagatgtctttgtttactgtacgtcctgctgcttcaattgcctgaagtgcgccaagtgccatagcatcgttgttgcagaagattacttcgatctggtcgccaaactgtgttaaagcgtcctgagcgatctgctgtgcctttgcctgatcccagtcaccgcgctgctttaacagttctttaacctgtactcctgcatcagtaagagccttaacagagaattctgttctgtactgagcatctacattctccgggtcaccctggatcatgatataggaaacaacgccgtcaccgttaatatcgcccttgttggaggtttcgagaatttcttctccctgataggtaccggactgtcttgcatcacagcctacataagtagcgttgatcttgtcatctttccatctctgctcttcctgggtatctggctcacggttaatgtaaacaaccgggattccagcttctttacacatatctgtgatttcaggagcagaagaagcctgaacaaggtttaaaatcaatacgtcgtatttctgagtgatgaaattctgaatctggttggtctgttcagcctgatcgcccttaccatcctggataacaacattttctttcttaaagcctaagtcttctgtcagatagcgctgaagctctgtacggtaaagtgtcataaagttatcatcaaatttgtaaattgagataccgactttcttatccgccacatctccgccaacagcatctttcactgcttctgcggtggtctctgctgcgcttgtatcctccttcttagtctctgctgccgtagtcgcctctgttggtgcggctgttgttgcctttgcgccgcctccgcagcctgccatggaaaataccattgctgatgcaaggcctactgctaatgcttttttgagtaatctcatgataaatcctcccttatcattatattgtatcgattggtgtttttaccttaccgacatgcacattatagctttcttttgtgcatttttccatatgatttttttcggatatgtatcgatttttttagattactcctgtttttatcaaatattttcgttttttttactcacaatgcacaactaaccgccaatattcgtatgaaagcagcgagacagatggagatacttgtattttcatttggctgccgcccattaaaaacctcattgcctgctgcaaagttcttaatgagcggtcagggccttctggctgcattcataatatttatcccggtccagtttcacaatttcctgtacattttggccaagagactctgctgcagcgatcttaaaaatcacattggcatactcctggctgtcgcactgaaccgttccaaacagctttcccgtgcggagtccttccagaccctgaggagtgccgtcaatccctacaatcttaaccggcctcatgtttcctttccggtccagggcatctgccgctcccaaagccatatcatcattgttgcagatcaccacttccacctcatccggatactccataagccactgctccatccatgccgaggcctggcttctgtcccaattggcaatacctccggtgatcttttccaagggcacgccgccatcctttaaggtctgaatggaccattccgtgcggatcaaagaatcctgatggctgttttcgccttccaaaagaacatagctgacctttccgtctccatttaagtcaagtgaggcaggatcctctttataggcatccaccagaatattcccctgaaggagtgcggactctttcgcattttctcccacataatatagcttttcccatcgccgcatatcctcctccaccggttcccggttaaagaagaccaccggcagattggcatccatggctttgccgatgatgttggaggcaactgagcgatctacaatattcacacaaatggcatcatatccaagggaaataaagcggtcaacctggctgttctgggtgttctgatttcccttggcatccacaatttccatgaccaccttaattcccgtttccttttcatattccttggcttgttcctcaatattccccctgagtgtattgataaaggaatcatccccgcggtataaggttaccccaatgcgtatggatttcttttcttcccttccctcctctttccggctctgataaaacactccccaaagtgccagcagcaggatgaccaccgctgccagaataccatatcgtttcttcataatacatcccccatttcaatcaattggatacaaaatcctttcaaatttactttcccgtaagtccgctttccggatatagtaagaatccaacacaatctgcgttctttgaagccccccatgaaccgcttccacagccttttcgatgctcatataaccggcatcaaactggtcacttgcaaccagccccttgataattccattgtccagctcttttaaaagcttggtggtgctgccgatcccgtaaagtccttcgatgatatttccgtataccggacttcctgaaatgatatccgcggtctcatcaaggctcctggcatcaatggccgcaatgaccgcttttccgcttccgggataaaccatgccctcaatggattcccgaaaggtcccctccgcctttttctcgtaaagcttcagggaaaatccggattttgaaagagcggataccagcccgtcataggcatccctgttatatccataatcaagcccttccgtaaatatccatacaggaatatccggggaagtctccgctgcgatcgcctgtccaagctttcttcccttctcctcataatccggtgaaatgccgcttttgacctgttcattgggaggcaaggttcccatcatgaccacagggctgtttaacaccatatcgtcgatcttttttacacattccactggctttacggggatcaggactatggctgatgcgccgtcgttgatttccctctgaaccagctcgatctgctgattggtatctcctttttcatagagcgtaataaagctgacatctacgttatattcctctgccgccttatccactccctttctgaaatttacgtaataatcatcagaagtatctccgatgatgacggaaaccggatatatttctgttttcttctccttgatgatcaaatccgttgatgataaaaggaacaggatcacaagtactcccgccagcagagtccacaataacttttcctgttttgtcataatctgtttcccctttcattgcccatgctttctgggcatagaggtatacccgcagggtgtttcccctttcattgcccatgcttttacggcagatcctgccccgttttgctggccgcagaagtgtccttttctatcatagagccatagggaaccgcaggaaggcggatgatgatcgccgtaccttcatcaggctccgactcaatggtcaggccgtatctttccccaaaatacagcttgatcctttcgttgacattttttacgccgattcctgaacctttttttgaagtaacatgaacctggtcggaaaacaagcctgccacctggtcttctgtcattccaaggccgttatcctttaccataatgcataagtcatctccagctttccagacctttaaaataacttctccatctccatccataaactccattccatgataaattgcattttccacaagaggctgcaacaccagctttaagcatgaaagctccatgcattcctcatctggatcgatctcataggagaatttatttttaaagcgcatctgctggatcatcagataattccgcacgtgttccaattcatctctgaccgtaataatgctcttccccttgctcaagctgatccggaagaaccgggccagggctgtcaccgctttgaccgcctccgccttttgctcgttttcaatcatccagacaatgatgtcaagggtattataaaggaaatggggattgatctgggactgtaaggtatcaaattcctgcttcctcttagcctcgtgttccgccacgatatcatccataaggacccggatctgctttgccatattttttatggagtttcccagatgctggatctcataggagcctccgatgaaaacaggggtgcctaaatttccctcctctaaaactcccacggatttttccagttccttaatgggattggtgatgcgggaagaaatataggagttgatcagggccaggataaacaggatcagggtgataaggaacacaataaaaagcctggtcttaatggaatttagggaaattacgttcttaggcgttaccccaatgatcttccagcctgtataaccgatggattttaccgtaatgatccgggtttctccctggaattcctcccggtggtttccatccttataatttgctgccaccagattgttttcctgcatccggccggaatcaatgagctggatctttggatggtacaggatctgcccgtcattgctgatcagatacacatagccgccctttcctgtggtcaccccgtcaaaaagatgttccagactggaatagcttaaatccaccagcagaacgccctgggtggtggaggttccctccgtcagctccacggccctggataaggatatcacccagcggtactggttttcattgctgtcaaaaacatactggacatgaggataggagaaatgttggttttccgtcttttccaaggcattgataaaccagttttccctggttacatcaagaccgcttttcagtcttgcggcagggacggactccaccatggtgcctgactgggaaaaaagagcgatgttgtccacattgtccttgttgttgtcatagaggagggtgatctcgttattaatggattccgaggaaagatccgcatttttaacggcaccgtaatacagggaatccgacagcttcatgaccgtaagcaaataggattccacagacctggccacctggttgatgaggctctggttttcctcctgcaccatttcccccacctgggtggaaaggcgctggtataaggaaaaagtgatcaaaagactggctgccagagcagtcacggtaaaatatacaaaaatagtataacgaatgctgatattctttctttccatattatcgtctatccttttggacgtaaagggatacccggagggtgtttcttttacctggctcctcggaatttagtcggtgatactccaaactttttcttaaatacatagctgaaataattctgctcctgatatcctacctttgctgccaccacataggtcttatcatcagttttgttgagcagctccaccgctttattcaaccggacatcagttaaatatgcgatgtatgcctgtcccgtttctttcttgaacatggtggaaaaatacgccgggctcatgtgaaggtggcggcatatcatctccacagataaatcaggattctggtagtggtccatgatatactgctttgcttcctggatcacctggcgggtggtgatatcacgctcctggttaatgaactgattcattttccccgcaattttaaaaagccactggccgaattcctcttttttcttaagcttatcaaagatttccatgtcctttagctccccgcccataatatcctcaatagccagatcatactgctgcatcatctgaaggacgctgtttaaaacgccgaacatataaacctgctgctggcggtaatggacctttgcggattccatcttttcaatgatcctggtaactgctgcctcgatcttttggtctgggccgaattttatggctgagattaaatctgcctctgttatgctgtcaaattccagcttgcctacacccaccggctccatatcattgatgtaaatggtggttcctcttccggctatggctttatagcccagagcatcaatggaggactggtaagcctcccggaaaccggacagctccctaaagcttttgccgatgcccatggtgaccggaacctccagaatccgctttgtttccttgcagatatctcccagcacatcgatcagacctgtggtggaattgtcatcatcaagagccacgatcaccaccatttccgcctctgaaacagactggaaaagggcgaacctgcaatagccttccagtttttcccttacgatctgcatgacggaaatggggatcagctcctcttcattatgaagggaaagtgtctccctcacatctcctttttccacatcaatggcaacgatgatccattttctggcccccatgacgggcacgccatattccttaagcttttgctccaccagttcctcggggagattcttgtgcaccaggtcattgaaaaactgctccctgatgattggcaggcttttccggtaattttcccgaaggcggcttaaattccttttttcttctatttcctgatccagatttcccttgatcctttttaggatagaggtcagttcttccacgttcacaggttttaaaatgtattccgtcacattcagcttgatcgctctctgggcatattcaaaatcatcataaccggaaaagatcaccaccttcatggaaggataccgctgacgtaccttctccgcaagggccaggccatccatgtaaggcatccggatatctgttaaaaccacatccggttctaaaacttcgattttttccatggcatcctctccgttttccgcatcccctaccacccggaatccggctgcctgccattcaattttcttaataatgcttttacgcacttcttcttcgtcatccactaaaattatgctgtataaatccatgctgttcttcccctcttaaaaatcccgtcgggtatgctaagttaccgttgtatctgataaagcagggcattgacaattgccgctgccacattgctgcctccctttcttccccttgccactataaaggaatgtcagaaagggacatgatcatttcctttgactggaccacattgacaaatcctacgggaacgccgatgatcagtctggggtgtattttcccttcttttatcagctcatataggcggaccagggcggtgggagcgtttcctactgcaaatatacagtcttccgaaagctctgccgctttatccatgctggcacaggcccgggtggtctggtggagttttgcgtattctgcaacgtcttcatcggccataaaacagctgacgctgcagccgttgcgttttagggcctttttattgattccggccattcccatgttggtgtcagtgatgatccggacaccttcttttaatgccttgatcccttccagtacggcgtggggggaaaatatcagattgtccgcatagtcaaaatcggcggtggtgtggatcacccgtttgattatggggtcgtattctgggttaaggactttttcaccgagttctagggttatgagttcaaaacttctcttttctatttcctcgggcagtacccgttccagcgctgattctttgcttttcatttgtacttcctttcatttgtttgtggagagaggatgtttcttggcggttttagtccgcagtggagctggcaaaacctgcggttttgccagctcacgggcattcgccctatgaaataggccatgagaagattttcttatgtgcaggcacaacgaaaatcttctcctgtcctatttctcactgctcattgctttcgtgaacattatcccataaatcctttccatgtcaaggctgttccttaacagggaggccagccggttatattgttcttccttatattcctgataattaaaaccgtcatccagttccatggaaattcccttcttttttgcaagggattttacaatggtcattgcaatcccttccttatcaaagaagccgtggatataggtgccgtatacatttcccctctggcagccatccattttggccaggtgggagcctgactggctttccatgacataggcgaggggcggcacggatctggtggtttctcccatgtggatctcatagccttccacctccatgcctgacagctcctcaaatattccccccacagcggtgcaggagccggacactcttgtcctggtcttttcctttccaaataccgtgcggaccggcaaaagtcccatgccccgtactgatgggacggccgtttctgattccatctggaagggatcggatatggtttctccaagcatctggaaaccgccgcagattccaaatatggggatttcccttgctttcagctttaagatggccgcctcaaggccgctttctctcagccatagtaggtcttcaacagtatttttgcttccaggtaaaatgaccatatccggatttcccagatcagatacacggtccacataccgcaggcacaccctggggaagcttaaaaagacctggaaatccgtgaaattggagattctgggcatccggatgacagcgatctccactgcggtccggtccgttctggccgttcctgccagatgatttccaaggctgtcctcatcttctaaatccacatccatgtagggaaccacacctgccacggggatggaaagccgctcttcgatcatgtccagtcccggttccagaatggttttatctccgcggaatttattgacgatcaaaccttttatcaaggctttttcatcaggttccaaaagcattacggttccataaagctgcgcaaacacgcctccccggtcaatgtcccccaccaagagtacgggagcctccgccatttttgccattcccatgtttacaatatcatcctgctttaaattgatctccgccgggcttccggctccttctatgacgatgatatcgtattcctctgaaagcttatggaatgcccgttcgatctccggcaccagtgttttcttgtatgcaaaatactctctggcaggcatatttccaatggatatgccgtttacaattacctgggacccaatgtcattggtgggctttaagaggatgggattcatggctgcctccggctttactcccgccgcttccgcctggaccgcctgggcccttcccatttccagtccctcttccgtaatataggaattcaaggccatattctgggatttgaaaggggccacccggtagccatcctgcttgaagatccggcataatccggccgcaatcagactttttccagcattggacatggtcccctgtatcatgatcgtctttgccatttggttatttcccttctgtcactatggatttcagtatggaaagaaacgcttcattttccttccgctgcttgacgcagatgcggtaataggtatggtcaagtcctctgtagttggaacaggaacgtatcagaactttccggttcaaaagttgtttataaagaagcttttccagggtaagggcttttggccttaaatccttgaaaaaaatataattggccatggagtcaaaaacctgaaagccaagatcagaaagggctgattttaaatactcccgttcacagctgattaactgtcttgttttctccacgtatgatctttctttaagagccgcctctcctgccgcctgggcaatgcttgaaacgctccagggctgacgtatgagattcatttggtccaaaacctctttttggctgcatattccataacccaggcgcagcccggccatggcgtacagctttgtaaatgcctttaagagaaacacgttctcataaccgccgcggcctataagatcaagaaccgaataccgttccggctcctgcaagaattcattaaagcattcgtccaccacgcaaaagattccatgatccctgcaatattccagaatctctgccatgacttccttgtttaccccaaagccggtgggattgttgggattgcatagaaacagcatctgaaaatctaccccgcttttttccagccagtttttcagttccttttcatttagctgaaacccgtattcctcccttagggcaaaatgcactacgttacaggaggacgctttaagggcctgttcgtattccagaaaagacggggcaatcagcagggcatttttcggttttaatgcctgtacgatttgaaagatcagatccgcggccccgtttccgcaaataatgtactccataggaaccccgtgaaagccggaaagctctttgcgaagtttcatggattggctgtccggatagcaggcgcactcatctgctgctttataaacagcctcttttactccctgaggaagcccaaggggattaatattggctgaataatccattgtcacgttgtttgtataaatatctccgccatggtggtattccatatcattttctcccggttaaatgtaaaattgtgtttaaaatgccatgaggaacatcagaaatacagggatcagccctaacacataggtaacggtcatcaggtaattagccctggggatatcctggtattctaccggccttaccggatctccaatggtaggcttttcatatagctttccaaaataataagcatttcccgccagctggatctgcaatgctcctgcacagaccgcttctgtctgggctgaattaggacttttgtggttgaaccgatcccgtttaaagatcctaaggccgttcctgccgctgtaagggttttcttttcccttgaatccatataaaagctgacacacataccctgctcctatcataagggccgcggataaccgggccggtatgaaattacagatatcatcaagcctggccgctgccctcccaaaccagagataccgttcatttttatagcctaccatggaatccatggtatttaccgccttatataaaaacactcccacgcctccaaagagagccatggagagcaaaggcgcaatgattccatctgaagtgttttccgccacggtttccaccgctgcctttgtgatcccctcttctgacaagttttttgtatcacggcctacaatcatggatacggccgttctggccccttccgcatctccactgaaaaacgccttatagaccttcatgctttcctcccgcagggaacgccatgccatcatctggccgcacatcacgctttctataagaaatccggcatagggagagaggaaataagcggtccacagaattgccccggacagggcacctgttaccaaaagcacaagaatcaccagacataaaccggctctcctttcccctgtttctcccttgggaaatcttttccttagttttttctccagccagcttatgagcgagccaatcccgcaaaccggatgccaaaggaaacggggatctccaaagcataaatccagaaagcatccggccagcactgctgctaaatgtaatcttatcatgttccatttcctgaccttttgtctatttgatccgagacgcaattccgcataccatgcggtaaacctctcctgaggtccgggctaatcttacagacgcccttcccgacacttctctccactgcctgtcccccggatccatgggcacgatgccgcagcccagttcattggaggtaataataacatggggattttgctgcaggaccgctgaaagaaagtcatcaacgctttttccttcttttaaaagccgtcttatatactcatgaagaccgtggatgatccggcacttcatggcagcttcaaagctgtccctgctgccttctgcgatctcatactcttcctttttctcatttttaaacgccggtgaatcagggggatatgctttctttgccagccccacggcaaaggccagctttccctgccaagctccgcctacaatcaatatcatgctttcctctttctatacccctatgggtgtttcctctctcttttacagtgttaccagatgggatacaacagccagtcctgccacaagggccagttcgcatatctgcagaaaatatcccgccagatcgccggtgatccctccaaactcccgccttgccatggcataataataccaataaataagaagagagatcaaaagggttgcaacggcaggaatcattcctcccagataccagattccccactccgccgctgccagatacaaaaccatcacaacagccactgccctcttcccagccgctccggaaaaggaggccgccagcccgctttcctttgccatgggaaatgtgacaacagacaggccgcttaaggcccttgtaaccacaaaggttatgcaatagaccggtatcatggccggacgcatttccaaaaaggcggccagataaagaaccatgtatacaccgcagccgatgatggcaaacgctcctgtatgaggatcttttaatatttcaagctttttcttcctctccccatgagaagatctggcatctaccacatccagaaatccatccatatggatgcctccagtaaccaggataggaattaccacaggaagtatttgtccgaaatgacgaaaaccaagagcattgcagccaaaaacaactgaaacgttcagcaggccgataactgctccggtaagtgggaaaaaacacataacatatttcatccgctcctttgtccattccagttggggcattggaacacgggagtacatggaaaacgcaataacaaagctgccaaaaagattcatattccacctcctcatgatgcttaaaccaggcggcacgcccggcatttaaaataatcataacacagaaaatggaaaatgtcatttccattcagaagtccttccgccagaaaccgccaaagaaactgaggcgtgttaatacacaaatagccatccccgcgcgcaaaatccggggaacggctatttctgcctgtctgtgtcattctcttccaaatatctttttcagcttttcaatcccaacttttggtgttctgtccggatacaaaaggccatttacctcctgcatcacatcagtcatctgagtataacagtatccggcaaaccttccgctgtttattaaaaaaccggtaacaggctccaggcgggcaaggaaatcatcttctccctgtaccttgttataatacccccagccccttcaccgttgtcaaaagcaataccgccatactccgtcaccagcaccggctgcccctgataggtttgtccctctgccagaacagccctggtttcagctcttccttcaataaccgctgcaaagtcatcgtacttatccaggttgtgaggctgcagcaggtaatcgtgaattgccaaaatatcggtatgctctgtttgttcccaaccgtcatttccgcttactattctggttggatccagagctttaatcagatatatcattgcatttgaaaagttctgctgctgaaggctggtccgcacattgcggattccccagctttcattgacaggcacccaggtaatcatacagggatggttaaaatcccggtcaatgaattccatcatttcgtttaccgaatgatacacggttctgtcattataaaggtagcagctgggcagctcaccccacaccagcaggccaagtctgtccgccaataataatatctgggatcatcaattttctgatgctttcttgcaccgttaaatcccatttcttttgtgagtcgcacatccttttttatggcttctccatcaggaggtgtcagaagggaatccggccagtacccctggtctaaaaccagacgctggtacagttcttctccatttaagtagacttttccctttcttatttccacggaacgcatgccgaaataggtgctgacccggtcaatggtctgctgatccttaagccttacctccacgtcaaccagatttggttcttttgggctccagatgatgtagtgccgtctgatatcccagtccggaaaagcaatgacacattttccgtatccgttttcacacaggatcgtctgccttcccagccagaccttttctcccaatgaaacggaatccactgttacttcaatttctgcctccagtttcctgttgtcagatagaaagacttcacagagtgcttcctgctcttccaggcggggagtgatcttaactctcgttatgtgggtatcaccggcatattccagccataccgactgccagatccctgttgtaggtgtataccagcacccaaaaagctcacctgtccagctctgcttgcccctgggcttatcagcctctttcccatcccggactttaaccgttaaaaccgttttttcttctttcacatagtccgtgatatctacttcaaaaggagtacttcccctttgtggattccggctaaacagccatttacataaacaaaggcttcataatccaccgctccgaatttaagcagcagacgccttccctttattttctcaaaatcagcatgaaaggttttccggtaccatacgatttcatgatcttccgtctcaccgattccgctcatttgagattgatagcaaaaaggaaccatgatttttctgtcaaaggaatccttgtcaaaggaaaaatcccattccccgtccaggctgatccagtccttgcggataaaatccggcctggggtaatattctctttccaacatctccacttccgccttccaattgtttttatatgtttcccctgctgccgattgctttcatggggcgtactccggtatccggagaaatatagctttgattccagtacccttttggatgaagctttgtccgatagcggttatgaggcacaggaagaggatccgaggccttcatcattgcagctgaaagctggattagaagctccgtttttatgccttggctgtccccatcctccataagttcctgcattcatggggatcgttctttaagttgtataaatatccctctcccatcatattcagctgaatgtggtaatctcccttccacaatgccctcacctgtccgcattgggtccaggtatttaggcagtcaaaggcttcccagttcttgggaactgctccctcctggggcagggtcagttcatccgcctcattccagaacaggccggaatacccgctttctgcataggctgtatcaaattcctgttttggaatctcctcatcctttagtacgggtaacaagcttttcccctggcagccaagaggtatatccacctccagcagattacagatggtaggaagaacatcaattaaatttacaaactctgtatttctcctcccatgtgccgggatccccggtcctctccagatcatagggatatgggccaatccatccggcagatccggccctttgcggatcagaccatattcaccggcaaagtccccgtggtctgatacaaaaataacaatcgtgtctttttctaaatctctttccctaagcccggtaatcagccgtttaaactggtcatcaataagccttagcatcccgtgatagttagaacgcgcccgcaggatacgtttgtcaatgtctgatcctaaaacctgttcccataccttgcgaagccagacaaaacgtggtcctttgccttctaattccgctgcgcctgcagccagttcaggaagactttcaggtgggaacatattaaaatacggttcaggcacctgataaggattatgaggctctgcaaatgacagccaggcaaaaaacggctgattctcctccgtctcgtcaataaaacggaatatggaagatacatttctatatggatgctgcacctccaccccctgaggggaagggacatgtgtttccatatgctttgtatcaattaaaaactttgcgaactccttttgggcaggtgttgtatttatttctccctcatttcccagatggccgcatgtttcatagtaatcaaactcctcgttctttctgtgggaatgatttttcccgcacagcgccatccggtatccgcaggatttaagaacatccatgagatcctcagtatataaggcatcaaccgcattatgattggtgcgcacctggtggcactggctgtagcggccggtaaacatactgaccctggccggcatacaggtaggatttggtgtataagcccggtcaaaatccaccccgccctttgcccattgatccaaaaagggcatggtgtccaattcatatcctctgctttttcgcagatcccagcgctgctggtcagtcataacaataattatattaggtttcttttccatcctgctatcctttcaccgcaccaatcattactcccttaacaaaatgtttctgaataaagggataaatgagaatcatcggtatgctggaaaccacaatggcagaatatttgattgcctctgccattttgattttttccgccattcccacatcatttgtgcccatttgctctgtctgccccaaaagaagtatattgcgaagaacaatctgcagaggatgtttggcggtgtcctttagataaatcaatgcatcaaaataagaattccagattcctaccgcatagtacaaaaccaaaaccgccagtatggccttgcttaaaggcagcacgattttaaacagcatttgaatgttcccgcagccgtctaaataagccgactcgtacagctcctcgggtatgctgttttcaaaaaatgtctttgccacaattaaattataggtggacagagccgcaggaactaaaactgcccataccgtattatacatacccaaatctctgacaagaagataagtgggcaccattcccccgctgaaatacatggtaaacaaaattcccatcatgagtaagtttcttcccggcagcccttttctggaaagcgggtaggctgccagaacagtcagcgtaacactgatcagggttccggcagcagtgtaaaacaaagagttggcaaatcccctccatatatccttgttttcaaaaaccatggtatatgcctttgttgttattcccttagggatgaggaatacctttccccgaatcaccatatccgggtcagaaaaggaggctgccatcacgaatatcaaggggatcagcacgatcaatattacaatcattgcgatcagggttatcacccagtcaaacagccggtcgctgtgaagagcttctgatatttttttcatgatacccccttaccaaagtcctgtttttgcggtctttttgctgatcatgtttgccccgaccagcagcaaaaaattaatgacagagttaaagataccaaccgccgtactatagctgaactggcctttttgtattccgttcttataaatgaaggtggaaatcacctcactgacagacagggtcacatccctctgcatgatcaataccttctcaaagcctacgtccataatgcttccgatcctcattattaaaagaatgagaatggttcccataattgcaggaattgaaatatgtatgatcttttgaaatctggaagctccgtcaatggaagccgcctcgtacagctggggatccacggaagtcagcgccgcaatataaattattgcattaaatcccatgtattgccacacattggaaaacacataaagaggctgaaacgccgtgggctttgacatataatccaccggccctattccgaagaaaccggttatctgattaaataatccatattctttattggaaaacaaggccagcatgctgacaattacgaccactgacaaaaagttcggcatataagtgatattttgtactgccttttttaagcgggtgtttttaatttcgttgataaccagcgccaaaaaaatcggcgccggaaatccaacaaaaagagtaaatacacttaaggaaaccgtattaaacagcacatccctaaaataataagaattaaaaaactgttcaaagtaagtgaaccccacccacggacttttcataattcccaaagtcgggttgaacctgcgaaaagcgatctgaagtccatacatgggaatatatttaaacacgatataccagattacagggattgccaggagtatgtacagccccatgtttttccggatatccttcagcaatttattagatcctgccttcatccttttcccctttattttgacgcatcaagtgctttctggtaaatttgctccagctccctgataccgatctgctccagggtagcgcagtattcatcccatttgtcaaagccccattcacccagaatgaactttgccactgcttcctttttatagttgttcaagtcctgctcaatggctgttaccctgtctaaatcctctatggcaactgagggcttggaatataccttatcaggaaggaaatccgcaagaacagccgccgcatcttttgttctctggcttgccactacatggtccgtggcatccgtgcgtatggatgggaaacctcctcccggtaccagggtgatcttgccaagggctgtcataaacccttccgggctgtttaaaatctcgtctttaaaccgcggagaaccattttcgtctaaatcatatgtctctccttctttcccaaaggcaaaaaataaatccccttccgttccatagaaataatccacccagcggatcgcagcttccggattggtgcaggtattgctgattgcaaagcttcccttggcaaacacaccgttttgtacgtctgcccacatcttatctccatgagggccggtaagaggctcataccctgtataactgtcctcacagttaatgaatacatctgaatatggcatgtacattgccccgaaaagttctcctgcaaggttgcttctccatgcgggcaaatctctcttataataatcctgccataaaagcccttccttatataggtcatttaaatacatcagatattccttaaatgcatcatctcccagccagttatgaagcgttccgctctcgtcaatattataagtatccttcatctgggtctggagcccaaagcttcctcccaggacataaacggcatccgcatccctgatccctaagggaatttcatcctttagaccatttccattgggatcctgatccctgaaggcaatcaatacatccttaaactcttcaagattggttggaatctcttttcctactgctttcagccatttctggtttatccactgcttaaactgaatcagccccgtcttgcttaagtcaatctgataaatggaataaatgtgcccatccgatgcagtaaaagcctgtttaattaaggggttttcctcaaaaatcctggtgagattcggggcatactcctcaattaaatcctcaagaggaatcagctgcccgctggtcactccataattggcgatctgctcctgggtaaaatcacagcggacaaacatatccggcaattcatttgaggcaaacaaaagctgcttgttctcctcaaagccttcccctcccggcacctcctggtaatccagccggatattggtcatcttctcgtattccttcaggatatagatctcattccatggtgcctgattttgatcctttgctccgtaaatgcttaaggttatgggttccttcacaacaggaaacccctccctgtttaaattgcctgcatttcccgtactttcaacgtccccgttgttctcagagggcacctggtcttcagcagtatttttgcttccacagcctgttaaaaggcttgctgccagggcaatgccaaccgccattcttgttaatcttttcattcattttctcccttccatcagttcattcatgataagaggattgtaacacgtttcttctgcctgaaatgggcggattactctttgatttttacctatctgttcactatttttactatcctttgttttgggcgatatattcttttggagttaagcctgtatactctttaaaggtacgcaaaaaatacccgtaattgcggaatccgcaccggtatacaatatcctttaaagggagattatcctccaacagcttttttgcacgttcaattcttatgttatttaagtattccgttatggtaaaatcagtctcttctcgaaaaatgcggcttaaataggaactgcttaccccaatataatccgatatcaccctgagactgattggctcatggaaatgcttgttctgataatctatggcctgattaaccacttgtgaaaaaccttgttccgcttttttcatttccctgatttctctcagcacattttgatataagcctgcaatattagaaaccagggtgtcacggctttttacctttgcatattgaaaaagcataaattcccttggtaaaaaatccagctttaactgatactcattggaaatccgctgaatgatctccaaaagctctttggtcaccatcagacatcttccatcctgattcaaaggaatatcttcataaatcatccgaaccagctgttctgcctggtcaggatcatgtttctctgccacggacagcaattgcttatattgcccaagagaaagggccagtgcagcctcttccttttccggcaccatggcttcctccagtttgtgaagcagaaaggatttaagggactcctcattaaaaaagaaaggacattgatacattttaatgcgcaaatgatacagacgtaatacactgtcttcaatcactacctggttgcatgtcatctgatttcgcatctccccctcagagaccgtatcataaaacctggtcaaaagtactacggagccgggatacatgacacaggccagcacatccatactgtctgtcgagacagcctcccctattttcccgatgccttccaatattccttcatctcttagccatgtatcatttcgcatatgctgtacagtaatgatggatgccaccattctgctgttatcagaagtaaacgggctgactccattttcccatatccaggcacttgcctgccgccttaagccggactttatttcccagggcgagcgttcttttattcttgccttcatatttttcagagtaaacaacaataattcttccgacagacggctttttaatatatagtcatgagccccattttttaaaagctctcttacatagtcataatcatcaaagctgctcactgccataattgccgtacggggatacagcttcgacaaaatgccggagagtaccacaccgtttttaccgggcattgacacatccaaaatcacaatatctgcagcctttctttccaaaaaaagcaacgcctcatccccgtttccagcctccccatacagctggaattctccttctttccaaagattcatgttctttatgtaagtacgaaaaaccggttcatcatcaacaagcaataccttcatttctaccccttccgcctgtctacaccccttctccaaagggcaggcacagctcaacacaggtaaacattccctcacagctgtatattgttcctccataaggctctccgtaaatcaatttgatccggttaaacacattggcaattccaatgcgccggaaccctgagcgttcctgctcattcacgtgatccaacagctttcgcaggatttcctcactcattccttttccattatccataattttgcagattacttctgattcctgtctgtatattttaatgttgatcataccgccctcagaccttgacgaaatcccatgaatcagtgcattttccaccaccggctgcaaaagcagcttaggaaccgggtatacccaaagttcctcatccacatcccataccacatcaaagggctggctgtacttaaatcgttcgatggcaataaaatcattcacataatccttctcttcccaaagggtgatatattcattgcgattggaaagcacgctgcgaagcagggaggaaagggattttgccacagactctatttcatcttcccctctcaagtgggcaacatattgcatgctgtcaatggaattatagagaaaatggggttcaatttgtgaagcaagcacatcctgctccgcctcccacctcatcttttctttacctgcgatttcttccatgagattctcaatccgatccatcattgtattaaaggtatctgccagatttccaatttcatcgttggtttttatttccattctgacactgagattcccctcatgattcacagattccatgccttttgaaaggctgcggatattcatgcatatccgttcagctaaaaaccagctggctaaaatagccgccagtgaggcaaaaatgccgatcaggagaaatttctgttttagattttcaacatcctttaatatcagatgctggggaatcaaggtgatcagggtcattttgcttgtatcggacagatactttgtataatattgccgttctcctccccaatccacataccctttgctttcttttttcatcctgatatcctggctgatctgtgtttcatcattatctgtgttggaaaataaaagctgcccatccggaagataaagataaatattcattgcatttaggggttcaatctcataagcagccatcatataatcatagtttaggtgaatgacaatcgtgccttttttcgacctgttttcatagaataccggccggctgagaagcagcagccgggagctggaatcataaaacagctccatcacttcactggaaagagctgttttcattgcttccgtctccaggtccttgcgaaacacaaagttttcaccccctgatagacttgtccgtcctccataatcaggagaatgtcctggatatattctttttgtataaaaaaaccggaaagaaaatctttgatctgctttttcttctgaaaaccttcataagtgacttcctctcctttctccagcaaattatgagaaatgatatcctgggccaaagcaacggaaaggaccacctttttcgagtcattgagcattacattaaaatctctgtccgcaaaggtcacatactgctccatgtacttttctgccgttttctttacgatacgggtttctgtataataggaaatcaacagggaagccaccaccgttccaattgcaagcaaaaggctgactgacattatttttgtttgaattgagttaatcttaagagacatttctcctcccccaatctgcttttcctttattgtatttgatatgaaatataaaaattgaatactatttttacttcttagtatactattttgcagtcactcctcattttatcatggattgctataaattcctattttcttatttcaccaatccgggactggttcctaagctgtgaataggccatgggcttgccggaaacccgaaagtaaaaaagaaacgctgcatagtcaaacagcgtttctctgatatctttatttttcctcccggtacatgccggtaagcttctccccggcttaataaggaggaccgcctcatcgcagacaacaacatgaaaatttacgaaatcgcccaggcggtaggttataatgattccgcacactttatccgagcctttaaggaagtgaccggaaaaagtcccggggattataaagcttcttcataaacagctgtacccttttttgcaaatacgaatatcatgccaaggacgcacaccaggccttccgtcacaacaaatgacagccagactcccgtcatcccccagatccggcttaagaggaacaccatgggaacaagcacaacacagccccttgccactgatacaaaaaaggcatgcagcccccgctctgcagcacttaaatacatgcatacaataatattgatcccggcaaagaaaaatccggcaaagtaaatccttaacccctcccttgcaagaagagcgattgcggcattctgctcactgttaaacacacttaccatttgatccgaagagaaaaataccaggaaatagattgctgatgcaatggccagggaggtgaaaaccgcatagcggagcagcttttttatgataatcccatttcctgatccataagccttgctgaccaacggctgtattccctgggcaattcctgtgaagaccgagattcctaccaatgcaatattagccacaattccgtaagaggccacacctaagttcccctccagcttcagaataacaagattaaaggtgatcaaaactatggccgaggacacttcagtaataaatgcggccatgcccagccccaggatatcactgacagcctttcttctgattctgccttgcctccaccggataccgctttttcccccgataaagtgggcagacaaaactccaaggctgataaccggtgccaggcctgtggcaaaggctgcaccaaacatccccattccaaggggaaacataaatatatagtccaatataatattggaaagactccctgtcagcattgcaatcatggccagcttaggatcattgtcattccttacaaatgccagcatgatattattcaggataaaaaacggtgcaaaacacagtattgtgcttaaatatgccttagtcaaaggcagtgtagctgcatctgctcccaataacacggccaaaggcccggagccaagtattcctgtgaccgcaaacaccactcccatcaaagttcccagctttaaactggcggcaaaaacagcattgatcccgttccccttattctgggattttaaaatactgtatctggtagctcctcccataccgatcattaatcctgtaccatgaatcagactgtaaatcccgattgaaaaattcagtgccgccagaccggcagcccccagtgcccttgatacaaaaaaggtatctgccagtatgtagcaggaaagccctatcattcccaatatattaaggctcacatatttgacatagctttttaagacagattgttccatctcatatcctccttttaatacaataaaaagtctgctttgcaggctctcccgccggagtgcggctgcctttgcaaccacatttccttagcccggagtgcccggccccggagggttttatatcataggaaataggttcctatgacataaaaaaggtgttcttaaaacattccttctacgacctaacggaatatttcagaacaccttgaaattctttacccggtggcaaagctcaggtttatatataaaactcaagttatcataatacagttttaacggattgtcaatcctttgtggcttaatcttttctttaaaaaactaaattacgttactcttcttttttatcaaaaagcttcttttcaagccactgaaaccccataataagcagtgtaataatgatgataactagaaatatactgaacattcccttccacataatacccagtgacagaagaaatttatcaaacatagctggctcctctctttcagacatcagaaattcccttggcagatactgatcataataaggtagttaaaaggtttaagacaattccccctgccaaaacagaggcgatctgccctgaaacattggccccgatggcatgcatcagcagatggttggtcgggtcttcctttatggacagcttctgtacaacacgggctgacatgggaaaagcggaaataccggctgcaccgatcatgggattgatcttattcttgcggaataaattaatgaacttggcaaacagaactcctcctatggtgtcaaatacaaatgcaacaaggccaaggatgagaatgacaagggtctgccaggttacaaaggcttccgccctcatgctgaaggaaacggtgatccccagcagcagggtaaccagattggcaagaatattctgtgccgcatctgacaggctgtgaagaacgccgcattctcttaataggtttccgaacatcagaaatcccaccagagaaacagactgaggcgcaacaagtcctgcaattatggacactgcaataggaaacaggatcttgatccttttggatactgatataggattataaggcatccggattaagcgttcctttttggtggtgaccagcttaatggcaaagggctggaccagaggaaccagagccatataggaatacgccgccaccgcaataggcccgatatagtttgacttaagtatctgagataccagaatggaagtgggtccgtcggcagcgccgatgattccgatggaggctgcgtcagaaagttcaaaaccaagtaagatggccacggtaatcgttaaaaagatgccaaactgagccgccgcaccgaacagcatcataatgggattggataaaagagggccaaaatcaatcatggctccgatcccgataaacagaaggagaggcagcgcttccgaggcctctatcccagtttcaaacagccactgaataatgccgtgggtatctcctattcccggaagagtctgatccaccacgccggacataggcaggttgaccaggatagcgccgaatcccattggaagaaggagagagggctcatacccctttttgacagcaagatagatcagtaaaaatcctacaaaatacatgactaactggggaattgtaatagaagtaatacctgacaataaaaaatccattttttagctcccttcacgtttgtgcttttcttatgccggcaaaatcatcttaagcaaccgaaaaacaagacctgctcctaaaccaggacacaggtcttgtcttttcaaataaaaccggaacattaccgttccggatattgatttcactgcagccaataaaatcaaggctttttcagctaccccatgatgactgttcctctatatctggcttttattaccatatcataagcatgcccacaagtcaacatgaacaaacatatttacacaaactcttaacgtttgtgagatactgacaaaggaaagtgatatcctgttaaggcagcagctcattaagatgagggaatacctcaatgctcctttttaaaatccccttcatataagcgatggcaattccataattggtaaaggccactcctgcatccgccgcacactttctccggtattccatctcccgttcatttaacatgcagccgccgcagtgaatgatcagcttataggacgataagtcatcgggaaattcccgtccggaggacgtttctatcaaaagctcttttcccgtatgctgccgaagccagcggggaagctttacggtcccaatatcatcacactgtctgtgatgggtacagccttcggaaatcaggatcttatccccatcctttaaatcgcccatagcagccactccttttacggagtcctctaaaaagcccttataccttgccatgaggatggaaaaggatgtgagaaggatctcttccggagtatccttatttacctgctcaaacgcctggctgtccgtaatgacaagatttggcctggttcccagcctttccagggtttcctttaattccgtttcacgcactacgacggatatgcctcccgcctccagaatgtcccggatcgcctgctgctgaggcaggataagacgtccttttggtgcagccttatcaatgggaattaccaaaaccaccagatcgtatggattcagtaaatctcccacaattctcagctttgtatccccggtgtttacaaggcttccgatccgttcctttaattcctggataaacaggccaagggacgcgctgacagaaagtccgtcctcatagttctgatctcctgttaaatcacatttattataagcgaccacataagggatcttcttttcctgaaacaaacggatcagttcttcatcggttttagtctttccaacagttccatccacgaccagaaccgcacagtcggcccggtttaatatctgcttggttttccttacccgcatctctcccaaagagccttcatcatcaaagcccggcgtatcaatgatgaccaccggtcccattgggagaagctccatggatttgtaaaccggatccgtggtagtccctttcacctcggacacaacggacagctcctgtcctgtcactgcattaacaacgcttgattttcctgcattgcggaggccgaaaaagccgatatgcacccgctcagaggatggtgtttcatttagtcccatggttatcacctcttctattgttaatttttgccatagcagacggcttataccagacttgtccggccttggccgctgcccgcagggtcagaaccggaaatccctgatcccattttctatgttctctaaatgatcctcacagatcaggcggaccttctcctttggaatgtggtttaattccgccgtaatcagggtttcaccgatccttcttgtatcctctgaagcgtaatctatcagatattcctttaatgtcatcaaggcattaggctggcagcagttctggatctgaccgcttttgcaaaggctcataaaacggtctcccgtacgtccttcccggtaacaggcagtacaaaaggaagggatatagcccatgtccatgagccagtgaaccacttcatccagggaacgctggtccgatacgtcaaactgctctgtgtccgtagggcggatttcctcctggtagcctcccacgctggttctggagcctccgctgatctgggatacgcccagccggatcaccttttcccttaccgcctggctttccctggtggaaacgatcattcccgtataggggactgaaatccggatcagggcgcagagctttgcaaatatttcatcatcgatcccattgtcaaaggcctccggatcaatgtcatctgccttcttgatgcgtggaacactaatggtatgaggtcctaccccatgaactgcctccaaatgctccgcatgcatcaaaagccctgcaaattcatactggtacagctccaatccaaagagaacgcccagacctacgtcgtcaatgccgccctccatggcccggtccatggcctcggtgtggtaggcgtagtcgtgtttgggacctgtgggatgaagcttttcatagctttctttatgataggtttcctgaaagagaatataggtcccgatttccgcctctttcagcttccggtaattttctaccgtggtagctgcaatgtttatattgacccggcggatggccccgtttttgtgcttgatggaatatatggttttgatgcaatccaggatatattccatgggattatttacaggatcctctcctgcttcaatggcaagccgcttatggcccatgtcctgaagggcaatgacttccctttccacctcttccatggtcagcttttttctggcgatgtgtttattttttaagtggtatggacagtaggtgcagccatttacgcagtagttggataaataaagaggagcaaacataacgatacggcttccatagaaatcctttttgatctgttctgccagatcatagacttcctgtattttttccgggatctcacaggccagaaggacagatgcctcccggtgggtcaggccctttgccagccttgccttggcgatgatctgatcgatcagttctccattggctttgtttttctccgcatagtcaagcgtttcaagaatttcttcatgggaaatgaactcttccgcttttagggattttggatcatacataatgttacttcctttcttttgggtcagcttctgcttctccgtcagttattattatcataaggttttgccttttaaaacagcttttttatgcctgttttccctgataggccgttttggaactgattccctttaattttccgatctttccggtcagggcggaaataatgctctggggcgcatccactgcaatactgatgatgctcacctgttttttgggataagggatgcccatgcggccaatgatgtgctgccggtactcgtgaaggatgtcattgagtaattccacggattcttcctcttctaccacgataccgattactgcaattctggtttccatcatctttcctccgttttattattttggatttctgctttgtgaaacaaaaaaaccgcgccataaaggcgcggcaaaataaacaatctctcaagtgccgaaccttctacctcaaaccggatttttggtgtcaggatgctgctatgataaaagcataccatacttgagattttttttcaattacccgtgcccataaaatattttttttgatatatctttaacgaaaaatggccttatgctataataatcggaagaatagctgcagaaacaggaggttcatatgaatacagaacaactcatcatggaaatgacagcattttatcagggagacccaaaacgaatccagcatttcataaaagttcacagttttgcccgcctgattggaatggaagaaaaaatcagcgaggaaacacagtttattttagagactgcggccattgtccatgacatcgggattaaggcgtcagaagaaaaatacggaagctccggcggaaaataccaggagctggaaggacctccggccgctgaaacgctgcttgccggactggggtatcaaaaggaggtaattgaaagagtttgttacctggtaggccatcaccatacatatcatggaatagatggccttgattatcagatacttgtagaagcagactttcttgtaaacatgtatgaagatcaaatgaatgcagattctatcaggtcagctttcaataagatttttcgcacagagacaggtaagtggctttgcaggaccatgtttgatacagggaagtctctttaaatccttttaaaataccatatcagaaagaaaatatgcattgctgttggcaaaaagccccttctcatccttgcattctacacggatataggcttcattcccatggaggggaaaccttgcttccctaatgctctccccccggactgccgcccttcggcaggtccttcccatatccgtgatcccgcagatagcctggacaggcccggtcttcaccaccaactccctgccttccgcataaatctcttttatctccggtcccatggagctgtagaaatggccatttaccagcgcatttacaacagcagcatagcttaaagcttccgcctttatcatggtaaagcccccgaaggagtcgcacagggattgtcaaaaggataactgttgtgattgtcatccgtggccatacaccacagccttttgcctaaacaaagcatatcatcataagcctgagggttataaccgtacagcccgtcatgctcacacccataattgtagatttccatggcaaaaagcccgtttaagcccttgtaatcgtcataattttgcaaggaccagtaagggtggttatagcaggaaagaaaccccagctccttcatctcctccagatacctgttgatgtaatcaaaatccccatacttacattccgggcagattccctgttccttcctggcccgctcatattccggctttgtatcatacaaatttatatgatacgtcttatcctttggccgcagccggtccggtcccgcctcattcatatccacctctacggctgcaagggtcaggaattcctcatcgtttaattcctcatgattccggtatatcctgtgatccgtaaatgccatgatctggtatccacgctttttataattttccttcgcctcttccggcgtcatccttccgtctgatacaaccgtatggctgtgaaggtttgctttataaaatcttcctgtctcaggcaataaataaattctgttttccaacttattttcctcccatcccttagatgccattttgcagaaaccgtttccaccgggcttttcccgcccagcataccgccgcccccaaaatggcaataatgatccaaatcaaaatggtagcatcccatcccacctgttcagacaatactccgatcccgtaggcagacattgctcctcccgcataagcagaggaatttaaaaccccggaagccgtggaggatttcccgtaaggagcaaaatatatgggcaccatgctgaccagcatggtgttcaccgccatcattgccgtggtcgccatgccaaataaaaccagtacggttaatacggattctcccttatagagccgcaataaaaacagtgctgcagcacataaggcaaaaaatgaagcagaagtggcgatttcgcttttaaaaatcttccggttggcaacagaggccatataaacgccgcttaaattaaaaaccggtataacggtggtgctgatgatggaaattacggattccatatgaaactcctcccggatgtaggtggggatccaggtggtcacgccatcctttaacactccctggaacatcagcccaaaacaaaagtatatcatccctgaggccagaatcagtttccacatggaggcgtccgtctgttttttatcctgtgaaataaagaccggttcttccataatcccgttttcttccacatcccgctttatctttcggctgcccgcataccagatcacgctgatagccgccagacacagggaagaaaagaaaaaaaccgttctccagtggaatttccatataatgagggcggtcagcccgtatgctgcaaaggtgcccacagggacgctgctgttgatgttgacgcagaattttttctggctgcctgtgggaatccagtcggaaaacaatttaatgatgggcgaccagatcagggactggaacaagccattgatgcaccacactacagccatctgccagacggctcctgacaatcccatcgccccattgcagattccggaaccaagaactcctataaaaatcattttgtaaggttttttcttatctcccatcactccgctgaaaagctgcccaaggccataggaaaagaagaatgcagttcctataaagcctgccgctcccttctcatatccttctgccctgatgatctccgttaaagaagcggaataattcagccttccaagataggtggaaaaataagctgtccagcataaccagaacagcatggactgtaccttttccgattggatctttttttgctgtacccttttgtccaaaatcatatctcctgctctttattaaattccaaaggcagatcctttaagaaatatgcattggaatctgcatacagcccgttttcactgcggcaggtcacacggatataaccttcccttcccgttaagggaaacctggccgcttccagagtttccccaaaaggcgccgcctttatatggcagttcctgccttccgtttttacataaatcttctccaccgggctggtctttaccaccaggtccctgccttctatgtagagggaatggatctcaggacccatggagctgtagaaatctccttgttttaaagccttcatcactgccggataggtaagctcctttgtcttgatctttataaaacccccaaaggaatcgcaaaagggatgtcccatgggatgttcattccggtttccgtcggatgccatgcaataaatcttcttacccttccgcagcatttcatcataggcctggggaatgtaaccgtttaatccttctatttccctgcggtaatgataaatctccatggcaaaaagcccttcaagccctgtatattcctcatacccctccatggaccggtatggatggctgttggttgccaggaaaccaagctgattcatcttctttatataagaattgatgtaagaacggtcatgctttcctgcttccagcctgtaaatttccgttttttcctcctgcccttcatccggaccggaatcatagaaaatcatggaagagcttcctccagcagtttgttccccgttcaggaaattttcctttaattccgcctcaaagcccgccagagccaggaaatcctttgtagtcagctccggatgagggcaatacattccaagatccgtataggctacgatctggtatcccctcttctcatattcctctttgatctgctcaggtgtcagccttccgtctgagaccgttgtgtggcagtgcatatttgccttataaaaatctccttcctttgggaggagataaatccgttcttccatttcttttccctttcctgcgtctctttccaatggggaaagaaagcgccgccaaatgtcatggcagcgctttctcattatttctgtgcttcttctattgcttcatttgctctgtcctgaatggatttcatggtatcttccagtgacttctgtccctggccgtataactgaccttcctcggtgtaaatctgtccgatggttgtatcagcagtacccatgatcttttctcccaagtatgctctgctgttgtcaaaccagcctgccataaaatcttctactgttaagttgtcatctttgaattttggaagcaggctgctttcaatataggcttttgcttcatcttctgttaagatcttggcaggaacacgtccatagcccaaagtatatttgttttcacaaatggttttgatggcctcaaatgcagcctccttgttcttggatgtcttagggattgcatagcagtttgtaattgtgagggaagacgggtcagaaccttccggataaggcatgggaagaattcccagttcccagtctctgggatatttcaccttgtcagataaggcacttgctacccagccgccgtatacgtacatgccgatgtttccatttaccataaaggagttgtatggatatgtaccggaagccagatccaggctgtttggctggatctttaattcatttccaaggctgaaaaaccactccatggcatcggcatatgccggatcatcaaaattagcggttccgtcttccttgtaaggggacacgcccttttgggtcgcctgcatatagttgcatgcaacgtcatcactcataaaggagccccagatattattatcagggttgtttaacttcttggctgtttccacatatttttcccaggtccagccttctgcggtgggataaggaacgtttgcttcatcaaagatcttcttgttatagtaggtcagccaaatatccttttctgccggaattgcatatgtctgatcctcaaattttaccgtttggcctccatacacagtatccatatcataattatctgcttttgcaagatcatcaatggactctaaaacagccgctttataaaattcctctaattgaaggggagttctgtttacgatatccatttcttctccggccatcaggcttacaagcaccttgtccatttctcccgctttagctgtgggagtaatgaaaaattctacattaatacctgttttttctttgattaattctatcatttcttttgtttcagtagccgttgcagcattatctgttaatgcccattttacggttactccgtcaaatggcttgtcactgttggatttctgggatgcttctgttgttgttttactgtcagcattggcctttgtgccgttggattgtccgcaaccggcagtacttaaaaccattgttgctgccaggctgaaagcagcgctccgtttcaatgcacttcttaatttcatttctgttaccctccttttgtttataatcccattatagctgacattttatggggtttatataggttgtattttaactttatgtgttattcttatcattccacggtttttttaaagaaaaccgatttttttattcatatataccaataaacgaaagagtgggcgctaccctggaatctataatttgtataatcaggatatccgattctatctgcggaaagcgggctatttttttataaccaacggtagttcctttatatatacttgcaaggattccgttcctcatggataaaatttcaaaagcctcaatcctctggctttttaatatattttcctttaaaatagctgcagaaatcctttgcggattcttccaggaaatcttaaattctgccttagggctttttccatgataataagtctcatagtcatctgtctgcacacccttcactgcattccattgattttcttctttaaccagaatttcagttccttctgccaggttattcccatatcttttttgtatttccctgcccatctcttccagtctttttacgtcttccccgtgaagcagtcccttgggcattggcggaatatttaaaagcagagctgcatttccacctacggatttttcgtaaatgtccataaggttttccaaagaccggaccttatcatcctcttccggatgataaaaccagcctggccttatggatacatccacttctgcgggataccagatcaaacgctgctcctgtgccagacgttccctgcttcccagatcctcttccatactgtctataaccctctgcttaaaagacgggtcatcagcatgctggctgaatgccgccacccgctctgctaaagataaatccgccggcacaacgctccattcactggtacgggtatcacctgcctcattgccgcaccagcggatatccggcccgcttacggaaatacaggcgtcgggcatatattttcttacggtatcataataacgctgccagtcatagacctgctttttaccattaggaccttctccgcaggcaccgtcaaaccatacgctgaaaatatctccatatcctgtaagcaattccataagctgtgcaacaaaataatcatcatatgcttttccctgcccataggtttcctgattccggtcccatggagaaagataaatgccgaatttcagacctgcattttcacaggctctcgcaacttcttttacaatatctccctttccattcatataaggactgtacttcacagaatgttttgtatatttactgggccataaacaaaatccgtcatggtgtttgcaggtgaggatcgcgcctttcatccctgccgccttaatcgcatgtatccattgatttgcatccatttgatcaggatgaaaaacttctgccggttctgttccatgtccccattctgttccggtaaaggtattcacagtaaaatgaaagaatgcataaaattctgtcttctgcaccatgacctgtctgtcagacggaacaatttttataagtctctcatctaattgtttcatttttcactctcttttctaccagtagacattccactgttttgtcagccgcacaagcgcttctgtataaaaataatctccccacaaagtacattcatcgacccctctgtcctttaccgaattatagggggaactttttgcataggtggaatgaagcaatattccgttggtattttcaccggaacggtataaacagtggtgtgtcagcgcctttattaaacgttttgcattctgcaatacagcttttgcctcatccggttccatgtattttgccatttcaagcattccgcaggctgcgattgccccggcagaagagtctctcggttccctgcagccatctgtaaaatcaaaatcccaataaggtactaaatccctgggcaaatgctccagaaagcaggctgtaatctttttaaaacgttccatgtacattgggtcaggacaatatttataagcaatcgccgaaccatagattccccatgactggccccttgcccatatggagccgtctctatatccctgtgcagtcactccgcccgccggatttccggtctccgggtcaaaataataggtgtggtatgtagaaaaatcttcacggactgcatatttcatggaggttcggatatgggccaaagcagcttcacagtactttggattctttgtttcctctgaggcccaaaataacagaggcatgtttaaaagacaatcaataattaaccgatattccctgggatctctgggctttccccatgcctgaaaaaattctcccttatcctgaaaccgtcccatcaggttatctgctgccatcagagcagtttctcttgccagcttgtcaccggtaagcttataggctgccacacaagagggggtatacaaaaatcccatatcatgatgatccactacaattctcttgatcaggcgttcccgaaagcccggtacttgataaagggcggcttccttaaaagccgcctcctttgtctgttcatatgccagccacagctgtccggtccagaatccattggtccaatcatcgttttctgatgcaggatatatctggttgatgctgcttgccgccgggaaagtatcataaaaatccgaaatattatttctgatccgggtaaccacatgattcagcgcttcaagtgcttcctctgcagtgattgcctcatacgcttcaagcgtttcctttgtctgcataatgaccatgatccctttctgatatatccggttgattcatcaggattcaaggaacgaaaaccacaaaatatcatttgcctttaactgcatggaacattcgttgccgtttccgtcataaatcacagtttcctgaggctcataggtgttatttacgatacaatatttgcctgtagccggataataattgacttcaatattataattgctgctgtaccatttcttcatctcctgctccatacctgctgcccagaagattgcccggtaaagcattctggaattttcaaaggaatagggaatgccgctgatatatacacttcttccctctccgaaccggttgaccgccatctggacatcttccccgtccttttttaagatttccgccccagtaagagcatagatattcttcatcccttctccgaaatcaatggcttcagaggaatcctttgtaataaaatgactgtgctcttcccagttgtatctatctgttgaaagggaaaaaccgacctctttgtttacgcccagcacatttgccaggttaaaataccggccctgatattcacaggcagacggctctcccactccgattaatccgcctcctgaagctacaaaggcttttacggcactgctgactctgggatcggcccagtaaaccccgccgctgggacctgtataagcgtcgcccacatttatgacaaccttgcatttatttaatacatccggatctgcgatcacatcctcaaagctgatgaattccacgtcaaaaggcattccgcttaaggcttccagcactccggcataggaataggtctgcttataatcaatggcatgggcgaccatatgggttccccaggaacggatctttccccaggaattcagcactcccaccttaaaatggctgtaagggctttgtcctcccacattttcataaagaagacggaattcatcacagacttcttcaatgtattggataaattccggaaattccagggctaactttaaatatccgccgtagccgatcctgtcaaccggttttcttaagatggcacgccttgcggtcacccagtttacttttgcttcttttatgggatctcccccttcatggaacacatcggggaagaaataaggcagaaaacggccttccgtatattttactcccggaatatcggaaatcagacgaagggtggttccattccccacacttccaaccaccgcatccagtcctacctgtttaaaatactctccaaagggttccgttccgatccagtggtctcccaaaaacatcatggcttccttgccgtggtcatgacagatatccacaaggaccttcataagccttgaaacctcccgctgctgaaattcctggaaatcgcggaactccttagatggcacccggttggtattgttatggtatccctggtcaatgatatattccgggcggaaggggtaacccacttctttttcaaactgttctaaaatatagggactgacgctggcgctgtatccaaaccagtcgacaaatttttcttttgcatattcattaaatacaagggtgaactgatgaaagaatgtggtaaaacgcactacattgctgtccggattttcttccatccagcggtttaacttttcaatcacgtgcttctgggtctttggctggcgcacatcaaaggtgatctgatgctccacatcctgccagtcattggtgatgaaattatacatatggaccggatcccagatgatgaaggccagaaaacttacggtataatcgtgataccgcttgggaaaggagatgacgacctcctgggtgctttcctcataatcccactcattggctgccagaggttcccctgtggtgcggtccaccacctcccaccagcgcttgatgtcatgaatggtatttggctttaactgctccttgtataaatgcttcatcaaagggattcgaaacccgccttcatccattgccgtataaaattccgtcatcaaatacacctgctggacttcatccgggttcgccatggcccaatcgttgtcctttctggtggtataataggtggagtaaattttgacgggcattttcttaagctcctccggcatatttgtcccatcacaatcccgcagggcatcggcaccccaccgcctggcaatctcctttgtctcctgtatcatatccacgtccgtgggaacagtgactcttccggtaagttttctttccatcttatatcccctttctatttcatcttttttgatttcaaaggcttatacgccccttatatttcatagatcagcccttcacaccggaggaggctaccccttcgataaaaaacttctggcagaacaggaaggcaatcagaatgggcagcagtacagccgttgccgcagccatctgacttccgtaatcctgaattaagccggaggaaaagagcttcactccaacggaaagcatctgcttatccatggttgatatgtacagatagggtcccatgtaatcgttccaggaccatgtaaaggaaaacagggccatggttgcaatggccggctttgccaatgggaaaatgattttccaataaatgcggaaatggccgcagccgtcaattttagccgcttcacttaaggagtccggaatggaaacaaaggactggcgcagaaggaatacaaaatacacatcaacacagcttggcaggatcagagaccacatggtatccaggatgtgcagatttttaaagatcatgtaccttggtatgatcataatgtcacttggtatcatcatggctgacagcaggacaagaaagatcgcgtcttttcccttaaatttaattcttgcaaatccatatgcagtaaagcttacaaaaaatatcttgatcgcaatggtaagggccgtcatgaccaccgtgttaaaataccatttctgaaagttataaatgccgtttgtaaataatgcctgaaaattcatcagggtggggttttccggaatcagatgccatggaaacttcatgacctctccgctgaccttaaaggaagaggaaatcatgaacagaaacggaaaattagacgccagcccgatcaacagaataaacactgtgagtactatctttatgcttttctttttgcttgtcattgatgattcctcccttaataattaacccattttttctgtccgcgccattggataagcgttacgatcatgacaagcacaaacatgatgaaagccattgcacttgccagactggtttcatattttgtaaatgcagtacggacaatatttacggacataacggtggtcgcctgtcccggacctccctcagtaagagcctgtatgcaggtaaagttctggaaggaaccgataatggagctgattacaaggaaaaaggtggtgggagaaatcattggtatgatgatattgcggatccgctgccattttgttgctccgtcaatctgtgccgcttccagcagctcagcgggcacctcctgaagcgctccaagataaaccaccatgttaaggccaacgcccttccagacggaaatcatagccacagtgggaagagccagctttaagttcagcaaaagcagcggcgggtcaaaccccatatttcttaaagcaaggattatgggactgttatttccaagcagtaccttaaaaattacggcaactgccaccatgttggatacgtaaggcataaacacaagggaacgcatggcctttttcatatagaccccgttgttcagcataaatgccagcacaaatccaaggatcataataaggggcacatataccagggaatattgaaaagtccttatgagggacgccatgatctccttgttggtgaatacttttataaagttttgaaaccctacaaatttaaggttgtccagcctggtaatatatttcatgtttataaacgacatcacaattgcaatgacaaaaggaatgccagtgaaaacagtgaaaaaaatcaggtagggcgaaataaacagccacccatacctgttttcttttttctgggctatggatgttttttcttttgttttagatactggtgtttttcccttgttcatgggcctgcctccgattttcattttaggaagaaaggcttatgaaacaacagcctttctcttacttctattctaacggattttttcccgataaacataggccgatttttgtatttgttggttattttcgctttttaccctgttttatttattttttaccgtcaaggggatattcacaattcgcttcgctgcttaattcagtcaaattgccgtgctcgtcaatgtcctctccggtgatcctgggaatccttatgacggtcagggttcctgcatcctttttgctataaatggaaacagccctgtccaccccaaaatacagcttgattctggcttctatgctgtgaagcccgatgccggtgctccgcctgttctgctcttcctcttcctttttgatttttccaaaacggatctgatcccggacttcccttaatttctccctgtccattccgcggccgttatccatgatttttattatgacccacctgcccttttccttcacagtaaggcggatcatcatggggtgctttaaacctgccattccatagagaaaggaattttccaccgcaggctgtaaaattatctttaaggaaaacagttcatggatctgccgcatgtccgtcttaagatcaaattcaaaatcttccttatagcggtttttctggatttttacgtaagccatgagatgctcgatttcatgttccattgggacgattacctgccctccgctgatggataaccggtacatccgtcccagggaagcggccgtccgcccaatatcaggccttcccgcctcattggacatccatacgatgttttccagggtattataaagaaaatgaggattgatctggctcatgagcacttccagctccagttcctttttcttccgttcagactgcagaccttcgatgatatgggtattgatccgctccagcatggaattataatagcggatcatatctcctacctcatttttctgttttacatcaacataggcatttaaatttccgccgtacacctccttcatggaggcgttcagctttccaatgggatccatgaagcttttatataaataaaagatcatcatggcgcaaaggctcacacatgccatcatgaccagaaagatcctgtagtacagcacatccacttcccttgtcaccgattttacgggaaccaccataacgatcttccagtcgttgacgtcagaggcctttacctggatcatctgcttcccctgagcctcccagccttttgttaattcctcttcctgttccatgatctcatcccttagcttctccggaatttctcctgcttccacagccgtttcgctgctggaagaaatcagtctgccgtcttctgtgaccacataaatatcaccgggaatggattctgccagttctgcatattgttcataaatatccttctcttttaatgcaaacagctgcacgcactcatatcttcccttttcccaggaataaatcctccggatgcccatgacggcctttctctccctgacctcactgggccggtcgctgagaaggaaattatcctggaggggaaaccagcggaatttcatcaaaagatcgggatcttcaatgttcatggcccgcagcctcttaatcacctcttccgtatcattattgggatccagaaaattaaataactctcccttgtacgtatacatggcgctgatcctcacccgctggttgagcatgtcataggctccgaatatgttgctgtaaatcctcacgatatcaagctttttatacatctgttcctgaggggaatattccttttcaatgtacttattcagctggtcattggccgcaaaattgtcggaaacactgtaaatgtcctgtagctttgcatcaattttattggcaatatccgtgatcctgctctgggtagtacgcatgtattcctgtttcatgacctttctcgtatgccagaacagcatggtgatgatcaccataaccgggatcagcacctgcaaaattccataaagcatccggcgcttcagaccaatattccttttctttacaagacggttttccctattcattttcattggttttcccccagctgctgccttccggctgtaggatattccggtactctttcggacttatcccatattttttcttaaacagcttaatgtaattggatacgtcggcccagcccatttcctgggaaatctcatagattttccgtgcaggatcagcaagaagctttctgcttttttccagtctttttgtaatgatgtaatcactgaagttgcagccaaattcatttttaaatatcttggaaatataggcggaatttttatgcacctttgtccccacatattccagggatatctggttggaatcatactcctcatccacgatttctctgatcttctgggcaagactgctctggctcctccattctcccctcatatccgccatctccctggaaacctcccggagtatacgggatagaaattcctttttttcctgcaggctttttaagggataaatgccggtataggtgcagtccagctttttcatcaccttttctaagcggacgccgtagcgcagcagggcgcgggaaagattaaacaacagttcaaggcttaagcggttgatataatcataatccagaatcacctttcccttaaattcggaaaagatgtcatctaaaatatcctctgccttattctcctcctgctccatgacttcctttaaaatctggcctgtatcaaaggaaactgcatagtaatcaaaatctgcttcctgtatccctttgtaggtcatgaccaggttctttccttcgctgtagatcttctggctggcacagcatttggcctgttcatagcactggggaagcatctggaaatccgcataaaaattgctgataccggcatatatgggaatgccgctctcctctaagaccgcttccgccatctgcctcacataggaatacagctcttcctccaaaggctcctccccggcgcttaatatcccggttatcttctcctcaaagttccagatataagttccgtcaatctcttcttttgaaactctttcatttaaaatcttttccaccttcatctgatcctgataataggcgtttttatcttccgtacctggtacatccaaatggatcagcatcacaccgtaccagttttcgccctggcagaagaattcttcctccatctcttcttcatgatagccgtatcccttgatcagtgcattgtattttcttctaagctttaagctcctgctctcttcatatgctgattttaattcccgttcttctaattccttttttccttcctcatcaagacgttcttttattttccggaaggtcacctcaaattcatccagatccgtaggctttaagagatattccatgacccggtttttaatggacatctgcaggtattcgaaatcattgtacccgcttaagatgatgatcttgatttccgggtagtgctggtttaaatgctgcatcagctcgatcccatccatttccggcatccggatatcggaaagcaccacatggggcttgtcctttttgatctgttccagcgcctctattccattgccgcagacaccgcttataacaaacccccatttttcccattcaatgctgtttgcgatcccatatgcaatcgacttttcatcttccaccaccaacagtttatacatctcgcacctccatcccgccatattatataacaaaatcccttatcatctcaagctgcttttccgtttgtacgcaaaggaagggcgtctaaaagcaaatcccatcctgtccatgcaatacctgcagaaactcaaacaatcacaggatattgcatcacatggagttaaaatttaacttttaagacgcctcgtttcctgcatcctgtatatttcataaggactcccattggctttcaacacaatcggtattcctgcgactacctcgatcacttcattggaaatttcagcgattctccggttgacctctccaagaaccttccggtaaaccagggtctcttctccatagctgtccccatcggaaaaaacctcattggtcacaatgataaaatgtccggtctcttcttctattctcctgatcccttccatgatctctcccactgcagatgttctctccgcgggcggagcttccccctggtctcccaggccaaaaagctcatttgacaccagatttgacatgcattccagaaggaccgacgaaggctgcagtctgttgatgttccgcttcagtccctttaaattccggtagcattccactgtctcaaactgcttttgtgccctcatctgcctgtgccggtctattctgcgcctgcattcctcatcccagggcttcatggtggcaatgtagatccgcctgccttctcccaggctcatgaccagactttccgcatattctgattttccgcttccgcttcctcccacaatcaaagtgatcatcattgtcctcccatgggtttatacgcttcaatatgtatgtcttcaaaggaactcatttttgtataaacgccggccgccatatcaagaagggggattgccgccaccgctccggtcccctctcccaggcacattcccgcctgtatcagaggtaaaagccccagctcatcaaggagcagtctgccggcaggctccgcagacacatgggaagccagcatgaagccactgcagcccggataaatgcggtctgcagaaagggccgctgccgcagaaataaatccgtccactaaaaccggtatccggtaaatggctccgcctagaaatacgccggtaagtcctgccagatcaaagcctcccacgcaggcaaggatatccaccgcatcccggcagacgggaccgtatctctctacggcctctctgatgacttccagcttcttttttaagccctcatcatttaatcccgcccctcttcctgtcagggcttccggagcttttttcagcagcagggaagcaaccgcactgctggtggtggtatttccgatccccatttccccggttgcgatcagatgatagccttttcccgccagctctccaaccagtttgatgcctgtctctatggatttaaccgcctcctcccgcttcatggcaggctctttgcggaaattatttgtcccgtaagcggtctttctgcagatgagaggataacgaaggccggagaacagatccctggcaacccccatatccactggaaatacatccaccccggcccgttctgccatgatgcagacgctgctgtctccctttgtcatgttctcagccacaagggcagtcacttccctgccggtctgggtgaccccttcctccacgatcccattgtcagcgcacaggatgagaagcgcccgtttatttatatccacttttgacgtttcccttatccctgccatctttatgatatcagcttccaggacgcctaagctgttaagaggctttgccacctgggaccatcggctgtgggcggtttccatggcagaagcgctaagaggccggatctgtgataagtatacattaagttcttcattcatcatttgaagcctttccaagtcaaagttttatgtcctttcctctgtttccttaaagcctttgcaggcctccacaaaacgctctggcagcacagggttagaaggataataaaaatgagggaagcctgccagcagatttccttctccatgaacgcagttccagctttttttaccgcctggttttattgcctccataccggctccgttgtttgtgctgtcccagtaatggaattcatggccccggatggattctcccttttttaaaaatggaatatcctctctggcaaacgcctcaatatagccaaaccgcaacaggcgttctgtcggaaacgctcttccgggtatgacgccagacaggcagtagcttttatggtcttttgtctccagctcctggtgaagatacagaaagcctccgcattcagccagtatgggaaggccgcgctccgaagcgtttcttatttcccggagcatggattcattttccgaaagctctttgcaataaagctccggatatcctcccccgagcaaaagaccgcaaatgccgggaggcagcgctttatcgtgaatgggactaaagggaataagccttgctcccatctcttcaaggagctttaagttctcctgataataaaagcagaaagcctcatcaaaggccattccaatgaccacttccttcccaggaatgacctgggaaacccggcattttgatctttctttaagagatggcagcggctttgcctcctgggccagctttataagtccatctacatcaatggtagattccagctttacggccagtttatgaagctgatcttttaaaccctttatttcccccggaagcacaagacccagatggcggctgccaaaggtcccttcttcacattccggcagatatccgtaaatatgtacccccagttcttccattgccggtctcagccgtcctgccataacggctgacgtccggtttaagatcacacccttgatatggctgttttctttatattccaagaagcccttcaccactgctgccagggacaggctggctcccttgcagtctaaaaccaggaccaccggtgtatccagggcacatgccacctcataggagcttgcatgagtggtatctccgcccactccgtcataataccccatgaccccttcaataacagaaatcccggctccctttgccctgtctgaaaactgctctctgacccgctgctgatccaggaaaaacgtgtctaaatttccgccgtcaatcccaagcacggatttatgaaacatgggatcaatataatccgggccacatttaaaggaccggcagggcagttttctcaagagaaaagcatttaatagtccgcaggtcatcatggtttttccgctgccgctcttaggggcagcaagcatcagcctgggataggaatcattcaaggatattcctcccttcccctccaaaggaaaccacatagacaggattttgtcccatcatcagatggtaatctcccgctttccttcctctggatacctgcacctgtacgatttccgccgggacggaatgttctttcagccaggatataatttcggacagagattccagggcgattgcattgattacgatcctggccccggattcttttttaaaaccagggaaagtaccttgtccatggatccggaggttccaccgataaatacgtgggaaggggcttcaagagataccaatgcctcaggcgctgctccttcgacgatttccaggcagtctgctgcaaatttttccttatttgcttttataagctctattgcttccgctttcttttccaccgcataaacccggcctccggtgagataccgggaagcttcaatggacacagagccggttccggctcctatatcatacaggacagaatcctgatccagctccagctttgatatggaaacagccctgacctcgctttttgtcatgggcacatctccacggataaacagttcatctctcataaattgcctctttctcaatcaatacggcagataatacatcaaactcctgcccttccagatcctccggcgttccaacggttatccgttcatcaggataggaaagccgctctcccacggacagcctggcttcgtaaaacccatgctccttaaggaggcagcacaggcttttcaccgtattggttccgtcaagaagagcaaataccctggaatgaagggtcaattcttttatcatgtcagaggtcctgccatgcaggctcacaaggcccacattctcccaaccggttttcagcctggaacataagtaggaaaccgatgatatcccaggcaggatctccgtatcatatatctggtcctggggctcctttgccaatgcttccgccatctttctggctccgctgtaaaagcccgtatctccggaatacaaaattccgatcctggaaaactccctgtgcttttcaagccagggcaggatgtctctgctggtataaaagggctttttgactgcatggggaattgcctgggaaacgcccaagagcattctctccgcaccaaatatcacatcacattgctttaattccttccatgcccttacggtcatctgatcctctccgcccatgccggttccgatcaaaaatacttttctcttttcaggctgccaaagtctgggcatagcctgacataagccctcttctttataatcagataaaagcttttttgcttctctgaccgtaatcccttcttcttttcccggacgtccgatgacaactgtcataatcccgcattctgatgccgcctccatcttttccggaaaacctcccgcagttccggcctcctttgtcacaaggcagctgatgtcatactgccttatcatggcccggttcatttcagctgtaaaagggccctgcataccgatcagatgcttccccttaaatcccatttcctcacaggcagagattacggacaaggacggcagaactctggcataaatccgctcctcccaggaatccagactggtaaaggctgaaagctccttgcttcccgttgtgactaaaatgtttcctgaaacgttctgcaaggcaaggaccgcttcttctaagccgcctgcccacaggatcttcccttctttctgatcccccggttccggcccctgggaagactcccttacgatcctcttgtaagtaactcctgccaattcacaggcagagcgtatgttttcactagccagaacagcataagggtgagtggcatcaagcacaagggtgattcccttttgttctataaacagttccatctcatgagcatccatggggctttcatggatatggagatactggctctccaaaagaaccattcttccatatccggtggcaacgctgacccatacatgtatttccttttggtgacagtattccgccaggatacggccttctgcggtgccgccaaaaatcaggaccctacacatttttatagcctcttggcgttaccattctgccgtctattaattttgtcatggaatttcctatatagacggtggtaaacatatctgtctgggtatctcttaggttttccagagtcatgaccgccatttcctcctcattcctgccaatattttttacaagtccgcatacggttgaccggcttttgaattccatgacgatctcacaagcacgtttcaaataatcggccctttttttgctggaaggattataaaggcagatgaccatatccgcctgagcggaagctttcagcctttcttcaattaattccattggagtgagtaagtcgcttaagctgattacagcaaagtcgtggccaagaggagcgcctaaaacagccccgccgcttaaggccgcagtcactccgggtatgatctcaatttccagcccttcctctgaacgggccatctcaagaatcaatccgctcatgccgtaaacgcctgaatctccgctgcataccattgccgtaattttcccttttttcgcctcgtcaatggccagcccgcaccgctcctgttccctgcgcattggtgtggaaagcatctccttacctggaaaatggtccttgatcaaatctatgtatacagtataccctacaataatctcactctcttccagggccttcacggcccttatggtcatatcctcataggaacccggaccgatccctaccacataaagcttacctgattttgtcatactttgtctccaccttccaatcccggactgccacagccgccgttactccttccaatgcctgtttcttcaccagaagattcccgcctcccagttcctttacacaggcaagggctgcccgttcacatacattatccactcctgtgacctgttttacaaaagaagaagaagagaattccccttctgtttctgcaagcacctctgccggataagtataaaacgggactcctttttcggcagcaaactggcagatgcccttttcttccttctttatatcaatgctggcacatgcggcaagacccttaagggataaattccattccttaaaaacccggtctataacacgttctacggtttcaacaggaacgccctttctgcagccgattcccaaaaccagaattcttggaaccagctttagggactccttaagcatctctctgaaagtttccctacaaaggtttttgccggaaggctttcgcccaagtcccccggaagctttcctgaaaccggaaaatcacaatgaaatcctacgctttccccctttaggatggcagaggatatctcttttatcttctttagttccgtaatgaccagtccctgctccctggcaaacaaatccaccgcaaatttgccgtggctgtctgtggccgtggtaatgaccggctgtccgcctgtcagctctgccagccgctctgccagttcattggcccctcccaaatggccggatagcagggaaatggaaaacctgcccatatcgtccatgaccaccacagccggatcctctgccttgctctttagaaagggcgcaatcgcccggacagcgatgcctgccgctcctatgaacacgatcccttccttttctgagaactgttctcttgtccattcagataaggatgttgtaacaggaagcagaatatccccgtcaggacaggatttaagaagggcttccgctccatatccttcacaagactggccgtcctttgaaatttcttttacaagctttgcacaaagccttgcccctgcctccgtaaagcagatgatggaaagtctcatccttcctcccccgttccctttctgtattcagtggtaaataccgggtcataaagcctggaacgttcatagctgctctgggccacggcattgcccacaagaatcagggctgtcttccttatattctcccgtccggcgctggcgcttaagctttccaccgtacagattacagtcttctcctccgcccaggtggctttataaacaatggctgcaggagtatccgggaaataaccgccttttatcaattcccttgacagctcatctaacattccggcgcttaaaaagatcaccatggtggctccgtgggcggcaaaggaagcaattgactcccgttccggcacaggcgttctgcccgccatgcgggtgataatcacgctttgggtcacatcaggaagggtatactccattttaagggcagaggctgcaccgcaaaaggagctgactcccgggcacacatcatagggaatccctctttcttccaactcatccatctgctctcttattgccccgtaaatgcagggatcaccggtatgaagtcttaccgtcgtctttccttccagctctgccgcttccataacggcaatcacttcctcaagggtcatttttgcgctgtcataaacctggcactgggcttttctgctttctaaaagagccgggtttaccaaagaaccagcgtaaataatcacatctgccctgtcaagcagatctttgcctcttactgtaattaagtccggcgctcccgggcctgctcctacgatatgtaccataattacctcacaatcaccaaagaataatagccggcatcctccgggatctccgccaaagaaccgtagatccgttcatccggcattccgcagttttccaccataatggcgcttgccccgcattttttcagttcctctttaaccgctctcatctgccggcctgccttcataagaacttttactcctgaaagctccagggcatctttgatctgataagaggccgggataatatgaagctcctctgatcctgataccaggggaatgccgacccttgccgccacggcacaaaaagaggggatcccgctttctaaccgggtggaatacccttccttcaaaagccgctcccaaaggtaagtaaaggtggaataaatgctcacatcccccagggtaatgaatcccacatcctcccccttatccagatgctccctgacctttctggctgccagctcgtggctttccttaagcacattctcatcctttgtcataggcatgtgcagataaaggcattccttttcctctatttccggcaccgcctgtctggcaatctgatatgccatacactgttctttatttttatggggaattgcaatgacctttaattccctgatccgttttaccgcctttaatgtcataagttccggatctcccggccctactccgattccgtacatgattccagccattgtttattcctcctgtttcttctctctgaccgctgccccggaaaacagcctgacaaactctacgcttccccggctcattcccagtataccgtacatggaggaaaatgtcaccacctccacctctgcaccgcctgaccacagggtcatgtatctctggatcctatctaccgcctcttccatgacaggctccaggatcttatggtccttaagaatgcctgcggcttcctccatggtattggctgttaaaattttatccttcactcggctcttttcctctgcgaaaggagctgtacaatcccataatatttccatacggcggtccccatatttggaatgggtattaggtacgcctcctgccaccttgatcagttttccaatatgtccggcaaacaggatccggcgaaatccctccttgcctgccgctttcaatgctttctctataaaattgctgcaagtcaccccatcctttagatcaagaccaagggtttcctgtataaaagcttctccataatttcccggaaccaggatcacctgtttcatacctgcaacagccttcatatgcagttctaagcgtatggtggcaatcaacgcttcttcactcatgggctttacgatccccgttgttcccagaatggaaagcccgccttcaattcccagcctgggattaaaggtcttttccgccagttttttcccttccggaatccagatggtgatggttagagaaccgtcaaacccggcttcccttctggcttcttccactccactaaatatcatgtcccgggggaccgggttaatggccggcatgcccaccggacaggacaagcccggccttgtcacccagccgatcccctctcctgcggtaagaaaaagaggggctttcccctcctccccatcccggcggtagattccctgggcctgtccttcttttttttcgtcggaatattggacagaggcaaacaccatggcctgatgggtcacatcagggtcatcccctgcatcctttttaacggcacacgccgcctctccctgttttaaaacaacatgaaaaagaggaagatcagccgaccttccttttggcatcataagcttcatatgttgtacttcacgtccggtaaacagcatgaccgccgctgccttggcagcaacagcggcacaggttcccgtggtaaatccacttcttaattctcgtttctccatcttcctgcatctttcctgcccattggttccgggcaaggccttcctctttgaagtacattataaaagattttcctctaaggtgcaagaaaaattctgacattaccgccttaatgcccatgctttccgggcagggccccccccgctttatggggtgtaaagggatggccgcagtacctatccttatacttcctcttcatttaccagggcttcttttttcatttctctttttctcttggtgataaggcctccgatccggccgctttcctttgcgctcagactgcgccaaccgctgtttattaccttatcactaaggccaagctctgtggcaatttcgaatttaagtacttcctccggcttcatattgcgaggatcaaatggttcgtttttctttccctttgacatatctttacatctccttttcttaaatctaaagagagtatgcccgctggcagaagaattaaacgtaaagtttctccagtattttcaaaagaaaagacaagcccggacggcctgccttttccttctctataatttcccttttatcttctgggaatgatgatcgctgcaataaagtaggccacgatgcctgtgcctgtacaggccagtactgcccataaaagccggatgatggtagaatccacattaaaatattccccaattccgccgcatactccgcaaagcattttgtccgtatcagaacggtataatttcctttgattatcttccatttgcgtatctcctctctgtcctttgacctgtaagatctgaaattacatcataaacctgcggttcatgatcaacattcgcctttcgcgccggtgagcgggctcatcttcgctctcttgcgctcattttatcataattcattcataaactccacttggatcgctcctgttttgcaatccagatccatgtttttatctgcaccgttatctgtctgcttctttccttttaaggcggcacttccttcgtctgcgacctttacagcccccatcttgcattggatatcgtaattataatcttcctttttcccggcaagttccagttttatggctcctacccggcagtccgcatcaatatcgccggaagtggctccggaaaattccacggctcccgcactggtttccacgtcaagctttcccacatttccgcggctgatctttactgcaccggcctggacttcaatttccagttcttccgcagacagggcctgggccattacagcagggccggattgttccctatctgaatagcggttcgaatgaacggattttaagctgacatgagaaaatcggtatccctccggcacctggacggtaaagaccagccccggaccatcctttcgttcccatccggtgtattcctgaagttccagctcatcatcttcctggtataagttccagcaggatttatccctgttgcagaaaatcttcacttcacttccctgtggatcctccacaaaaacaacgtttcccgtacgtattactatatccagttttttcacttcctgagaagaaaaaatttcctgccctttctctcctctgttaaaaacttcgggaacgtaaatattatcaaaattcccctcatcccagaagctatccagggcaattcctgaaatttctcttctccattccatggctctttcaggtattatatcctgtaaatttcctcccatcccagcagctacggctgaaattcctccgcccaccagaacgcagatacttccggcgatcaaacatatctttacaaaccttttcatagacggcttctccttccgtgaaataacctgctaaggacgtttacacagcttctgaaaagaaacggaagaaatcttccataaaaagcgccgctcacagccagggctaacagaccaagaccaaggaacaggatccccagtcccagaagcaaggctccgcttaaggggtggatcaccatggaaacaaaactggcaaaaatcatacaaactccggctataaggagtgcaagagtaatcgctccgattccgatgaccgctgccacaaggcatcccaaaagaccgcctgccagacctgcaataccgcctccgattcccataagcatgggagaagctgcaatgattaaaatgatccacaaaacagtttttacggtccggttcccattcatgccccttcttcgcctgccgtgccttttatccgtttcttctccctggtattttgggtcctcagatacctcaggaaggtcataccggtttgccatctggtaattgggatccttaaaccgctcatcctggtagccggtctccgtaaattcccctccgtcttttaaattcccggatatatctgaacggataatggctgctattcgctcagggcttacaaattcacgtattactttttcctcattttccggtcctgcttcttccagataatcccggtaatatccaatggcatccgccttttcctcatctggaatatccgacagcagatattccagcgctctcataaactcatccctgctcatatatgtgcctcctcaaaaatccgggatatcttctgcgagtagccttcccactcacctttatagagattcaattgaacccgtcccttttccgtaattttataataccgccggtttcttccgtcaaatgccagatcataaacctccagacactcttccttctgcaatctccggagtaccggataaagggtggattctgaaatctcaataacatttcttacatcctgggtaatcttataaccataggtaccctcctgatcccttgatactaccgcaaggacaatggcgtccaataatgctgctcctgtgttaaaaaccatgtgtccactcctatctttattatcgcccatgttttttgggcatagaggtatacccgaagggtatatccatgatgctttgataaaaacctaccttgactcatccttcggtgcctgtggtatgatcaccgcagctatgatataaagaaccaggcttcctcccaccagggaaaatcccataaatgaccggaacaaatgacgccatgactgaagaaacatcaaaagcacccatatcagccttatcatgacaggatcgacctgaaaatattctccaatgccgccgcatactccgcagaggactctgttctttacagaccggtacaaacgttttggctccacgattgccacctacctttcttccatatgaactgatatataatattattttattctgtatattatataccgtataataatattatatgccatataatattacttgtcaacacctattattttttttgaaatcatttttataaaaaccaaaaaacggatgccctcaagtgattcatttcacattgaaagcatccgttactattttccctcagtccctgaaatacaatttgtcagtgaagcttggcgatcctgttcaccacatcaatgtattcactgcagtacatccgataaacgatcataacagccgcacggaaacgcgcatgttccaccgtacttagttccgtgacaacacagcccgcttttgtcagcatgtccctgacattctgctcacgggtcttccatagctctctttcataacgggcagactcttctgcacatgttgaaatgatttccctgtctgttccgctcaaatggtcccaggtggcctgagagacaagctgcatctcaggaatccggttgtgggcatccagggtaatgtattttgccacctcataatgacgcatgctttcataggaaggccagttattttccgcaccatcaatactgctggtctgcaaagccgcatatacttcagagtaagccatgggcactgccctggcccccagtgcctctatcatagctgccatcatgtcggactctgccacacggatgcgcatgttctttatatcttccacacgttctatgggtccagaggaattataaaaatgtctggctcctgcatcataccaggaaagggctaccagcccgcttccctccagttccttcttgaactcatctccaatctccccatcaagcaccttccacatatgagtttcatcccggtataaaaaaggaagctgcaggacattaaatttggacttaacatcggccagaatcatgacagaaacccgggcaaaatcaattccaccatattgaagctgttccaccacatcattctcatttcccatttccccttcagcaaacacattgatcttgattcttccatccgttctctcgtataccagttccgcaaatttctttgccccctgtacggtaggatagtcctccggctggttatctgcataagaaaacacatactccggcgcttttttccggcctgtcataaaaagagaatcccctattttcccccatttcataagactgaaaacaaagaaaacagagaccgccaaaaagaggacacacaaagccccttttgcaatccgtttatccattcgttctacccccaaaacgtctttcctttatacacagaaagcgtctgatattttatattattttccgattatggttgacatccctaaactcattacgattgaagatctttcagtctgtccattctgtattcggacggatttaccccttccaagcgcttaaaaacctttgtaaaataattggaatcagcatatcccaccctgaccccaacttctttcacattcacgttaggctgatccagaagcttttttgcctctctgactctgtattccgttaaataagaggtaaagctctgcccatactgcagcttaaacatcttgcaaaaataaggttcagaatatcccactgccctggctgtttcactcattgatatatcattcatataatttaaccggatgtattcctctaccatggatgtcatcacagacaaccggttgccataaaaatcaggctcatcttccctaaccgtctgcgcttttttcttttcgttcaattgatcagcttcctccgctgtcctttgcggttttattctgtcctgactgtcttcccgttcatcagtgagccgcaatgcctcttcaactacactcacaacttctctctgggaataaggctttaacaaatattccatggctttaatggaaatcgccttttttgcgtaatcaaaacggtcataagccgttaaaaatataaggctgcaatcctttttttcctttctcatgatctccgcagcctggattccgttcattcccggcattccaatatccagaattaccacctggatatcttctctttgaaaaatctccaccgcctcttttccgttctgcgcctcatagatccggcactcctctccgaacttcttatgaagcatctttttcagcacaatgcgctcaatcatttcatcttccactatcatcaaccgatacatgatccatcttttcccttctacgaccaaattcaatctgcacctttgttccgcttttttcactgctgtcaatggtcactttcccatattcgtaatatgaagaaattcttctgtatatattacccagcccgattccaagtccggtacccttggtttcagccgccttccggatagcagcaagcttttcaggaggcattccctttcccgtatcagctacggatatccataaaagctctcctcttctttttatggatatgtcaatgcttcctccgctttctttttccgatataccatgaattaccgcattctcaaccagcggctgaagtaaaaagaccggcacttcttcctgatataagcttttgctgcagtaaattttccattgtatcctatttccaaaacgcatctgttggatatacatataatccttcacaaccttcagttcctgttcaagtggctcaaaggcattggacgtacggagactgtaacgaagaagattgctgattgccaccagcatttcctccgtcaccggtgcctcttccatctgtgccatcctggtgatcatattcagcgtattaaagagaaaatggggatttaactggcttttaatcagctgaagctgggccatggaaaaccgattctcaaggtctgcccgctccaattcctgccggtgcagcatttcttccatcatccgtttttcctcattggccgtaaagtagtcctttgtggcatgcttcatcttattaaacgcactcaccagctgcccgatttcatcccttccatcccagagaacatcaggagaggaaaaatcatttttttcgattttaccggaaactgtggccagctgtacaaccgttttcactatgctgcctgtaataaagcgcaaaaggatcagaagtaccagaaaggcgacgatactgatcgcaactagaatataaggcatacgcttaagcacagggatctgaatttcgtaataatcatttcccccattaaaaccaccttggtcagacgtgtcccataaatgtccagatatttctgcatactgtatgttttatacagctccttaatatagccgggatcagtctggctcatggccaccaccttttcccgctgctcctcataagtaccataacagtttataatattccaggtgatcccgtagcgcttttcccctattttatcgtaatcatagggcaggctgtttatatatgttttagtctcctggcaggcccgccggtaggcttcctcattttccggagaattatttgccagcaaccgggcaaagcatccgctctcattctccatggactcctggaatttataacaggccaggttgtcatccatgataatactcacatcgttaataaaaatatatgctactttcagattgataaagatagaagccgccataatgatccccacacttacgatgatcacgtacattttccgctttaaagacatctgataccagagagcaagcaattgatctcccacctgtttccctccccaaattcttttttgccgtataccaattaatcttatcccttcctcggccttccgtcaatatttttacaaaaagaagggaatcagtcaaggtataacggaaacctttctcatggcgcaaaaaaatgccctgtaagcagtacacagctttttctgtgcatcacttacagggcagggttcatcccatggatattaaattacaggttaaaggccttccaaaggcgcttaaaataatcggtaaatttagcttctctgaccgcttcggctgttaatatgggaacttcccctatcttttgccctccaaggctatagatcaggcttcctgccttctgcccttcttctaccggcgcagggatggaaggctccagcgccaggttcctttcaatagtggaaaaatcctctcccttaaggcttaaataggaaaaagaacctccatattttaacgggacctgatctgccaccccgttatccacaaccatgtcaggaagggggagcatttccttatcctcatacagcttgcaattggcatatccatagtttaaaagggtctgggcatcggcaaacctgactttgtaatccggggcagccataatcgaagcaatgaggcggactccctccttttccgcggttgcggaaaggcaatactttgccactgatgtggaaccggtctttaaacctgtcacagtaaaattcgtggccatttttaaaagcttattggtgttggaaagaccaaattcctttgtcccctgctttgtcacatgagtgatattctccatccagatggtggaatagttatggatctgaggatatttattgatcagttctctggacataagtgcaatatccctggccgttgtcacatgagtgcctgactcagtaagcccgcagcagtcttcaaaatgggtatttgtcatcccaagtcctgccgctctttcattcatcattctaacaaattcgtcttccgttcctgctatgtattccgccatggctactgaggcgtcattccctgaagcaatgacaatacacttgatcagggtatccaccgtctgcacttccccttcttccagaaaaacctgggagccacccatggactttgcgtgagcgctggtcacaacctcatccgtcagcttgatcttgcccgaatccaacgcatcaaaaataagtattaaagtcatgatctttgtaatgctggccgggctccttttttcatccgggttcttttcataaataatctgtccggttgacgcttccatcagaacggcgcttggagactgtaaggccggaccgccctccgcattcacctttttcgcctcttctgcctggataatcatgtccgaggctaccgccatatccggctcttgccctgccgccggaaagcacaaacagaaaaacagcagaaggcagcttaaaacaaatgccgtaactctcttcatatgatacacgatcccctaaaattcctttgtatcattgtatgggattgtttcatatacatatgccattttttccaaaaaaaattgcctgcttttcatttcatcttccggtaaagtatgctatacttgtaccggatatgtataaattttttttatactgtcccaatactacagaaataatgaggttaagctatgaacaaacatgattttcgcggatggaattccggcagaggccggaacaatacattgcaggttatcctaattcttcttttgggaattctaatcgtcactgttttgaccctatgcggaattgcgatcaacaagaaactcaaattcaaggcattacccgccgattcctcagtggcagagctcccctcagatgaagaaacacagattccttccaccgaagagactacatcaagtgaacaggcggaagaagaaaagttaatgtctttcctatctcaggcggaagccctttctgtggtgtatgattatgagggtgcgatcagtctcctacagtctgatcccagcttcagcgaaagggaagaagtgacttctgccattaccggctatacgaccgcaaaggatgccctggtaaggatcaatccccaggatgtgacccatgtttttttccactcccttattatggataactcaaaagcttttgacggagattccaagcaggcaggctataaccagatgatgaccaccagttcggaattccttaaaatcatgcagtccatgtatgacaaaggatatgttctggtgaagatccacgaccttgcatatgagacaaaagacgagaacggcaatccgaaatttgtatacggtgatattatgcttcctccaggcaagaaggcctttgttctgtcacaggacgacgtatgctattatgaatatatggaaggcgacggctttgcttcccgcatgatcatcggagaagacggatatccaacctgtgagatgaaaatgcctgacggcagcgtttcagtgggcgattatgatctggtgcccattcttgaaaactttataaaaacccatcccggcttttcctacaaaggagcaagaggcattctggcctttaccggctacaacgggatcctgggataccggacagatgaatcctataaggacaccaatcccaattatgaagcggaccgggaacaggctgcaaaggttgcccaggccttaaaagatcatggctgggagctggcttcacacagctggggccaccggaatatgggaaccatccatatgagccattttaaggcggactctgataaatgggcgcgcaacgttgaaactttaacaggaccgacagatattattctcttcccctttggaagcgatatcggaagctggacaccttataccaatgacaatgaacgttttacatatttacagtctcttggcttccgctatttctgcaatgtggacgccagcaaacccacctggatgcagatgggcaccgactatttccgacaggcccggagaaacttagacggataccggatgtattattatcctgacagcttaacggatctgtttcaagttcctgatgtttttgatccggcaagacccacacccgtgcctcccatgtgatgggagggatcgggtaggaagaagtaaaaaagggatgtacaaaactaacttacatcagttttgtacatccccctttttatgggctgatccgtgttctcttaaaactgcacaaatcccttgattggctgggccggagccaccgactctgcatacaatacagggccttctccttcataatccttccagaactcataggcgatttttgctctgacacgaacccattgttttgtttccagttcccttgcctccctggcttttgtgacaaagcccaaaaaggtcatatcatcttcgcagcaggtcattgccatgcgccccggaacaaaataatttttagggaaatcaggtgttttcaaaaccatggcagtaaattccacagtctttccctcatagcggtcccgtctttccatacagtcaatataccagatgccataggcttccggtgaaatttccactacatcagagctcatgtcataaggcagatcttcctccgggatctcattgatctctccctcggaatcttcaaatacgagctctcccttaggacacatcgcttttagggtccgcctgtaaccggataaatcctcgatcccgtcacagcggttgcaaatgaccatctccgaattgcggaccatggaatacagcaagggcttcatattggcagaatatatatcaaaggtggacatgtcgatcagggtgatctgctgatagactttccagtcatcgggaagcttcagctcatctaaattccacattccattccactcgatcagaacacgttccggattgtaaagcagttccagttccaaaagcctgtccggattcagctcgtctatgctttcaataaatatccctgccgttttgttgcgttttagcaaggcctggtcatactcggtttcaccgtcttcgcaaacgatcaacagggttttttcatcagacttaaaataatcctgctccatggtgaactgaaggaactgggtctttccagcctctaaaaatccatttatgaggaataccggcataaagtcgtcttccattgtatctgtgctgctcataattttcctcctaatgaatcaagcggatatgcttgcatatccagttgattcacaaatttaaggttaaaggatgatttttttcaaccttcctctttccccgcccttctctcagggcataaaggtagccctgtaaggggttcccttcattccgcttatcttccaaaggactttttaagttcctcttcctttaaattcgctccaatcacgcaaaccttgccggtatattccggcgctccgcttcggatctcatattgctccggaaccaaatcaaaataaagccatgtccccttctcctcgcctggaatcatgcctttggcacgaagcacatcaccaaagctgtctccataagccagctcgtcaagaatcttgtccagctcgtccctgctcatcgcccctgcattctcaagaccccagctgttaaatacttcgtctgcatcatggccgtgatcgtggccgcagccgcagccttcgccatggtcgtgatggtggtggccgcgctcttcttcatggtcatcgtggtgatgctcgtggccgcagccacatgcttccacttcatgatcgtggtgatgcccgtggccgcagccgcactcttccactccatgatcatggtgatgcccgtggccgcagccgcactcttccacttcatgatcatggtgatgcccgtggccgcagccgcactcttccacttcatgatcatggtgatgcccgtggccgcagctgcactcttcgctgtgatggtgatgacggcgatctctcacttccttcatcaaatcctctgccatggtatccggtttctctatgatctccagaagctgttttccggtcaattcctcacatggagtcgtcacaacaactgcctttggattcagctcccggatgatctggacagcctgatccaccttgtcagcaggagcgatatcggtacggctcaataccacggtacccgcattttcgatctggttattaaaaaattctccgaaattctttctgtacattttacatttctgcgcatccacaatggtgaccgcactgtttaaggtcacttccacttcagaggccacgtcgataactgctttcataacatcagataatttacccactcctgacggttcaatgatcacccgttccggatggtattttgtcagcacctcttcaagggattttccgaaatcccctaccagagagcagcagatgcagccggaattcatttcccggatctcgatccctgcgtcctttaaaaagcctccgtcaataccgatttcaccaaattcattttcaatcaggacaacctgctctccggcaatggcttcctgcagcagttttttaataaaagttgtttttccggctccaagaaaaccggaaataatatcaattttcgtcatatcaataggtaccccttttctttccagagttttacatgaaattacatttatttattgtgtcacaaacctttaacaaagtcaagcagcggtccaagggtttttccgggttatattgtttaaaaattatcaattttaacaaaattttgcataaaaacttgcattctggtaattttatgataaaatacatggcaactgctttgacaaaggtcaaatgtgtgcaccaaactatttaaaggagatttttatcatggaaaaatgcggcgtaaaagaattcctcaagaggaaaaacgtcacaattactgtccagacctatctcattgatgcattgggtgctatggcatttggcctttttgcgtctcttttgatcggaaccatctttggtactctgggtcagcaattcaacctcacgattttcaatgtgatcgcagactacgcaaaaagcgctacaggagcagccctgggcgttgccattgcctatgcccttcacgcccctgccctggtcctcttttctgcggcaactgtgggcattgccggcaatgctctaggcgggcctgtaggtgctctcgctgcaacagtggtttccgcggagctgggaaagatcgtctcaaaggaaacccggctggacattctggtcaccccgggtgtgaccatcatttccggagtcctcatcgctcagtcaataggaccgggcgtagcaggctttatgagctggtttggctcacttgtgaaaacagccacagaacttcagccattatttatgggaatcctggtatcagccctgatcggcatcgccctcaccctgcccatcagcagcgccgccatctgcatcgccttatctcttgacggcctggcaggcggagccgccacagcaggctgctgtgcacagatgatcggctttgcagtcctttccttccgggaaaacggggtaggtggccttatggcccagggccttggcaccagcatgctgcagatggggaatattgtgaaaaatccaaaagtctggatcgcccccactctcacttccatgatcaccggccccatagccaccatggtattccagctgaaaaacatacctgctggctcaggcatgggacatgcggtctggtaggccctatcggggtctacaccgccatgaggggcggagctttcatgtgggttggcatactggtggtatgcttccttctccctgccattctcacccttgtgttcggtgaaatacttagaaaaatcggctggatcaaattcggagacttaacactggatctaaaataagaaaaaaacgggaaggaggatgccgcaaaatcaatgagcggcatcctccttttaccttttatgactctttcttttcttcatcaaaattccggaatgcgcagttactgcagcctccgctgcaatgtccgcagccgcagccgccttttcccttatttttcacgaactttctcactgaaaaacaaaccagcaccaaaagaatcatggctatgataaccgtggaaccattggaagctaaccatgcaggcataacaaacctcctatcgcttctctactttaattcctttagtatatgctcaatatggtctcttttgccaatgaccatcaaatgttcctgggcctggatcacataatcagccggggcatgagctgtgccctgccttcccgcttgattccaaggacactgatatgatatttgtttctgatatccacttcccttatggacttgtgcacccattccggaagaggcggaatctcataaatggaatattccggcgtcagctcaatatagtcaaatacgtggtccgtgctgtaacggacagacagtttttccgcaatgtccctgtcagggtaaatgacctcatctgctccgtttcgcagcaggaatttggcgtgaatatcacggttggccttgctgatcacccgcctgccgcccagttccttgaccaggctggtgatctccagactgctttggaaatttgtccctatgcacacaaagcacaagtcaaaattagatattcccaggctccttaaaaccgtttcattggtacagtctcccacctttgcactggtgacatagggaagtaaatcctccaggaattcttccttctggtccacgatcatgatatcgttgccaagccttgccatgttgatgcacagatgatgaccaaatcggccaagtccaataattaaaattgatttcataattttactccttttcctctaacctatattgatcgtttctgtcacctgttccacatgagccttgcgctggctctgagcaaatgccagggcaaatgataaacttccgatccttccgctgtacatgaggataataatgatcacccgtgatatgggataaagatctctggtaatacctgtggtcatacctactgttccgatggctgatgccgtttcaaacagtatgtccgaaaatcccaaaggctggattgccataatggtcaaagacgcggaaagagccaggaataagttaatggtcaaaatagcccctgcccgtttaatggcagtctcctccaggcgccttccaaaaatattgaccccataggtctgtttgatattggaatgaacacacataaggagtacaaacactgttgtggtcttaatacctcctgccgtagatcccgggcttccaccgatgaacatgaggataatggtcagtaatttactcccatcggtaagggccgccgtatcagtggtattaaaaccggctgttctggcggttacggagctgaacagggatgtgaggatctgcccgcttgcattcattcccaccagcaggttgttctgctccagcaggtagaaaaggaatcctccgccaaagaccagaatcgtggtgctcaccaaaaccatttttgtatgcagcatatattttttaaagtgaagcttattcttgtgtatgtcatcccatacgataaaaccgataccgcctataatgatcagggacataatgaccagattcaccagccagtcatcgtaataggctacaaaggaactatagggcgtctgatttcccattaaatcaaaccctgcattgcaaaacgcggaaatagagtggaaaatgccgtaaaacactccccgccagaacccgaattcaggaataaaacggatggcaagaaggatggccccgatcccttcaaaaagacaggtcccttttatgatcccctttgccagccttaccacacctccgatctgcagggtgttgacgctttcctgcaaaagccctctctcctttaatcctatcttccgtctcagcacgatagagataaacactcctaccgtcacaaacccgaggcctccgatctgtatcatggtcatgatcaccacctggccgaacaaagaccactgggtccaggtgtcccttacaatcagtcctgtcacacaggacgcgctggtagccgtaaacaggcagcttaaaaaatcttcagactgcccatccctgctggaaatggggagcattaaaagaagggctcctgccatgatcagacagaaaaaaccataagcaataaactgtgtctggctcacgtgccgtttggcacgttttaattgtttttcttccatgttcatttcactgtctttcctcttttcctgtgatcccgtattccgcctttttacttacccggtctccggctatgtgccttgtaaaatcatagtatgggaaccggttagtcacgaccttaagcttaggttcacctgtataagagggccttccggctctgttacacccccacaacggcacaactgcaaaaggaatagccaggcataaaaacaggagttttttccatctattttcactcatttttaatctcctatctgattccatttgcatagtatagcacattttattcggaaggaaaaggacagtttttcatttgcacaggaaaaggcctgtaaaagacataagaagaaaaactccttctgccatatacaggccaaacatcattttatctcttattttttacccgaagctcgatctgtttgctgatctcctttacctcatctgagggttcgtaattttcttcatcaaataaaaactggtgaagcctttttacgtttgattccagggtcacggggacaacacagtctcttttgccgatcatcacatctttaagctttgagggaaatccttctgtttcagtcaggtggaaccgttttatattttttatcagaggaaacatgtccttcatgccaatgcttgtggatatctggggaacacagcagcaactaccttgctgagagtcgccgcatccgcttctcttgcctttttaagagctaaatcggcaacctctctctggcgctcggtccgtttaaaatccgtatccatttttctaagccttgcgtaggcaaccgcctgaactccgtctaagtggtttgggccttcctttttcaaatgatgggagcctacgcctgtggattccacggtttccgtgataaaaccgttgatcacacggaattcttcatggctgatatccacatcaatccctcccagaagattgatggcatctgcaactgctttccagctaaaggaggcatactcgtcaatggtcaaatccagattatcatttaaagcttcaatggcctgcttatggccgcctttaaaatatgcttcattaatcttatcataacgctcttttccctctatccttaaataggtatccctgtaaacggaaaccagccgtatttcacctgtaccgagatttacattaagaatcatctgcatatccgacctggttccctttccaagggttccttccctggaatccacgccaaacaccgccacggtccagtagccctccattttttcctgtgtctcaatgcttatattggtattttgcatctgaggcaattgtatctttggagccgtctgggcatgtgtatgatgttccaggcatatcccagcatcgacccgattaaagccgcccagacggccgctatggcgatcaatccccattttaagtaattagtagtcatggttcctcccttatccttcaataaaaaaagaagagatactcattcttatctctccttaattttcctttattttaagattttattcaagaacatgtctgatctcgctgggatgatcaataatatattttggatgaaaagcttccaactccgctctctcacgaaagccccaggtcacggccaccgtatccattcccgcattgatgcccgtcctcatatcagtgttggtatccccaaaatacaggcattcccaaggctttgcctgaaagtactccgccgtcataaaagctcccgaaggatctggcttgcatttaacatccttgctttccccggtaattaaatcaaaaaatcctttgccgtaaacagcttccacacattcaacagcacgttcatgacctttgtttgtcagaactccgattttaattcccttattcttcagaaattttaaaagctctggcatcccatcatatggcttcacctgataaaggcagttcttctcaaatgtatcctcataaaatgcaagagcctcctcaaaatgggtcagcttatcatctcctgagtaaataagggcccgctccaccagctttttatatccatcgccaacaaatgtcttggtatgggccacatctatgggctgatagccaaaatgctccatggtcaggctgatgctgtgagccagagaatcaatggtatcgataatagtcccgtccagatcaaagatacagcatttatacatcgttttctcctcctgctttcttcctgcttcttttaattatagagcatgtctataaaaaaatccacccatttcccaagctccggctgcattcttaaagatttcaaccctgtttttttgcaggcgcaaaaacggagctattgctccggcagattatttatctacttttgcaacagccccttttacctatttttattaataaacggacttccattcatcaatgttggaagtatcaaatttaaatggaggcccaagaataatctccgttccgccatctgatgccccgatcacttcgtaatcgcccatttcccctgcggcgaacttatcaccggcttgccctgtgatagctccgtctaccaaggcaatggaagtataggcccctaagaaacctacgtcaataggattccacaagtacatgtaaggacaggaatgagcgtcatcattgccaatgtattcagccatttcagatggaagtccctggcctgtcagcttaactttggatttctcatcctgaagaacctttgccgccgcattaattccaacggtggttggtgcgcagataacccttagatccgggtatttggacaaaagcgcctgagtctggtccgtggatttctggggctcgtcatctccatatgcaatctctaccagattgagctttgaatacttatcttccttcataacctctttcatggcttcgatccaggcattctgattggtagcctgggatgtggcggaaagaatcgcccagtccccctcgccccctgagatatcatagacggcctccattaaggcctgaccgatttccatagttccagcctgattgacaaaagtttggcgactgtccttattcactttggaatccagacaggaaaccttgattcctgctgccatagcttcctccaaagccgcctgcagggcgttttcatcatttcctgctatgcagagggcatctacgccctgggagatcagggattggataacagaaacctgggcatccgctgtagcagactccggatgcttgataatgcaggttccaccctcagcctcaatgaccttttgaaagccctgggccattttttcattatatggattgccggccgccttcgtaacgatggcaaaggtcttgcctgctgctcccccggttcttgtcccgtcatttgacgcagcctcagttttctgtggggacaccgtactttcctctgttccgcttttactgccgcagcctgcaaggatccctgaaagcacagcaatacacaggaatgcacaaatcaattgttttctcatgttagaattacctcccttttccatttttcttaatttttatactgaacaccttttggtgttacgtatcacgcttgtttccgttttctactttttaatagctctggtatcataactgccagaattaacagggtaccaagaatcaccagaatgacctggggattcatgttcatctgtcctaagccgatccggagacagataatgataaatgcggatatcatggctccggttaattttccctttccgcctgctgtggaaatcccgccgaacacagccatggcaatggcatccagctcaaagcctgttcctgtagtggtatttgcaccgtagaggaccgaaaccagaaacatggcgctgatgcctgccatcataccggtaacagaataaactgccagccgcattttctgcacacggatgccggaataaaaagaagtggtccggttgcttccaatggcatagagccttcgcccaaaggaagtcctgcttaaaataaaaatgaaaataactgccgcaaacaggaccgcaaaaaggatataaggtatgggcccgattttccctgccagtgtccgaaagccttcattatgctttaaggacactgagcctccgcttcccagtgcaatttccccaatcccgcggaatatgatcatcgtggccagtgtgacgatcatggagggcagctctgtaaacagggtgactgcaatcccgttaaaaagtccgcaggcggttcccacaagaattccgatcaaaatgacagccgggaatggaatgcccgcatttcccgccaggcaggcggtggttgccgataagcagaccgtcgcgcccaccgacaagtcgatctctcctaaaatgaggacataagccataggaagcagcagaaacacctcagttaagtatttcggcatttcccgcagcacattggtgagcttatagcttggagagatgaccatgcataacaggtttactgcaaaaaagagaaataccagcaccccttcccagctgagaaggctttttttccagctttgctctgcctgcgcagatatggttcttcccgattttcccgccatgaatcacatctcccttccttttaagttttccttttgcatcatgcgctgcgccactacgttgaaaatgataacagccagaataatacagcccttaacggtattctgtacgatggaatcgattcccacgagaggaagtgccttggcaatgactgccaggatcagggagcctaacaaagcgcctgtcacggttccccggcctcccgacatgctcactcccccgatgacacaggccgcgatcacatccatttcctttccgtaaagcatgttaggctgggcggaggaatagacagcaactgcaagggcaccgcacaaaccggccagagttcccataagggtgtagactaacagcttgatccttttggtattgatgccggacacggcagctgcttccgggttgctgcctaccgcataaatctttctccctgttctggtccatttcataactgcaaagaagatgatatagcacaccaggacaatgacaataacattatttaatataccaagccccagttccttttccaatgcaaaattcttaaagcctcccagattttccgcactggcccactggcttttggcaatcaaataggcaagccccctgtatatgtacatgaatcccatggtggcgataatcggaagcacctttcctcttgctaccacaaaaccaatgatcgccccgcacaaagcgcctgttaaaatggcggtgagaaacagcagaagcgtattatgaatgatgttatatttaagaagcattcccacagtcatgccggaaagagccagggtggaggtgatggaaatgtcgattcctcctaccagcagaacgcaaagcattcccagggccataatcatgatgactgcattgtttttcagcatatccagaatggattttgccgtcagaaatgatgggctgaatatctggatcaccatgcagaggatcaccagaacaaggaacaggctggcttctctggagccggtgatattctttagcaattttttctccattattgggaactcctttccatggcatgctggagaatggcttcctgagtcgcctcccccggtttaactcacctgacagtctgccattgcacatgaccagaatgcggtcgctcatgcccaaaatctccggcatttccgaggatatgagaagaattccgtatcctttcttcgctaaatcccccataatctgatagatctcggcctttgcgcctacatctactcccttggtgggttcatccatgatgacgactttcatctcctggcttaaagcctttgccaccaccactttctgctggttcccgccggatagggagccggccggatcaaagatggaaaccgcctttgtatccacttcttccaaaagctgttttgcggtctcacattccattttttcatttgtgataccgtattttgcatatttacccatgatgggcagggtcacattgcgccccaaaccccaggcgagaataagacctgctctctgacggtcctccggaagaaggacaagcccttctctcatggcatcagccgggtgctttatggatacacgccttccctcaagataaacatttccggaatctggctttgtaatgccgcagatactttccgccacctctgttctccctgcccctacaagtcccgtaagccccagaatctccccctggtgcagtgtaaagcttatgtctttaaaatatccggtccttgacatgttttccaccttaaggatctccggaccggtctttacctccggttttgggtaaagatccctgatctcacggcctaccatggccttgatcagctccccattggtaattacacctgattcataggtcccgatgtaccgggaatcccggaaaacagttacccggtccgccagccggtacatatcctcaaaccggtgagaaataaagataacagaaacaccggaggcctttaactgatccacgatccggtacaagtcttcggattcattttttgtcagagctgctgtgggttcatcaagaatgatgattctggcccgtgtggataatgcctttgcgatttccaccatctgctgttgtgcaacactcaaggtgcccatttcatcggcagccttaaaatctgcattcagctccagtaaaagcttatcagcctcctgattcatccgtttccactggatcatgccgttttttacgatttcatggcccataaatatattctccgttaccgtaaggtccgggtaagaggtgggatgctggtaaacagcagcaattcctgctgcctgggcatctcttggccctttaaattctgtctgattcccgtccagaatgatttctccttcatcagccctgtgaactcctgttatcaccttgataaatgttgattttcccgctccgttttcccccatcagagcatgaacttctccctttttcaagctgaaatggactttatctaaggctttcacaccgggaaatatttttgtaacgccctttaattccagaacatattcggacacggccgcttcctcccttcttaagctgggatcattttaccatctgttggatatggaagaaacagcataatcttttgataacgggtaatatatttttaactttttcgttgataacagcaatagcaagggttttgtattgtgttttttggttattttgctagaataataatggataaatgctggaaggagactgttatgaaattgctgatcgttgatgatgaagagctcacacgtaccgggctgattgattctatagactgggaatctcttggcatttttcagctgttccaggctgaggacggcattagcgggcttcgcattgcaaaggaagtgattcctgaaatcgttttatgcgatgtaaggatgcccagaatggatggaattgagatggtggaacggctggaaaagctgcttcctcattcggcctttatttttatgagcggttattcagataaagaatatttaaaagcagccatccgcttaaaggccatcaactatgtggaaaaacccctggatcctgcagaggtgaaaagctctatcaaggatgcctacaactgtgtccgtcagaatatgaggactgtgaaaaatgaactgttttattccaggggaaccgcctcttcctttgccgcggcccttacccacccttacagggacaataaggaaaccgtcgcagcccttgcaaaagagctgggccttaagctcacctcccatgcaggctttacttcttttgttgtcaagctggaacagagccagacggaccagaaccttatggatcagatactgacggatctggaggtatttctttcccattcccagatgcaggtttactatgtgtcaaaatatatccagtaccatgtgttccatattctttctcctgtgttaccttctcatggagccgtaaaccggatcggcgttttcttaaagaattgctttgatacagcctgtaccttctatatcagcagaggagaaacttataccggcatcgcaagggcctacgattcctatgcatctgcggtttctcttatgcagagcagctttttctttgatcctggaacattttttactcctgaagagaaacagacggaatatacggataaacagggcaggaataagtctgacgaggaggcttatatcacccttttatcggaggccgttttaaataatgaccagaaaaaaggaagggagctgcttctgcgcctttatgagaatttttaccagaggagaggggtttctccccatgaggcaaaggatctttattataagcttattatggtgttagaggactgccgccagactcttaggctggcacctgtcactgagccggaaaatgccatgaagcttcttgaaagctgctttagctttcgggatctgcaccaaaagctgacgcaaaaaaccgaactgctttttgaagcagcccggtcccatatgtgggaagataccaccatttttctaattaaagaatacatccacaatcattatcacgacgaaaccctttcagtacgggatattggcggtcaggtttacctatccgcatcttatgtgtgcacgtattttaaaaatgaaacaggacaaaccattaaccagtaccttacggattaccggatgaaaaaggccaaagagcttctggccgattcccgttatcagattgccgatatttcaaacaaggtaggatacagcaacggaaattatttcagcaagagctttaaaaaaatgactggcttgtcgccgtccgattaccgggagaaaatgttgaaatgaacaatataatacaaagaggaaagttcatctataataacatgatgctgcagacaaagtttaccatcacccatatggtcatcaccaccatacccatgctggtcatgttcttcttttttcacggaaagctttatgatatggttttagccgataccatccggacggaacaaactgcttctgccatgaccatgccgcagattgatcagctgattgaaacatgtctggatgcgcagaaaagcctggaagcccatccttattataaaaagctgttccgcctgaccggataccagccttccaactggattaatgattccgctgaggcatccgatttgtgcatggcagcggaagacatcgttgacggcgattacataacgaatattcttatttatctggatattcctgaatttcaggaaatctttcacaatgaagcttccagccggatcttccgccccatgagagaggccagagggtcttattggcacggaattttccagggggaccggaccctgacctctctcttttgtccggaattctatttaagtcccatagagataagggaatcaggggatatggcctacattaccaaaacctccattctgtataatagtgagtaccacacctgctatactgctatctattactccaaagcaccatttaaaaaacttttaaagaacaatctaacagaggataccagcgtggcctatatcatcaatgaccgggacagcactgttgcaacctctgatgacggactggcgggaatttaccatttcagctatgacaaggtccgggatttctttatgtcgtccaataattttgtcctcaggaatatcctggatcatgatgtttatgccggtttttattatatcagaaaagcggactggtttatggttgcagtcatccccaccagagccattattcaaaaaagctttctccttatgatcggctttttcttcatatacttactttgcgtattgatttcctttttaattgcaaaccggctgtcccactccattaccaaccggatttcctctgtgatcgggcaaatggcaaaggtgcgtacagagccgcccacccctctgcccgcatctctttaccatgatgaaatcggagagctgattaacacctacaattatatgaccaggatgatgaacaggctcattgaggatcagcaaaaagctgctgaggacttacgggccgctgagttcaattcccttcagacccaaatcaatccccattttctgtacaataccatggacatgatcaactggctggcaaagcagggccggactgaagaggtttcggaggcagtcgtagacctttcccgtttttacaagctgactttaagccgtaaaagtaccttaagcaccattgccgatgagctggagcatgtgaaaacctatgtccggcttcaaaatatgcgttaccatcagattattaactttgtggatgatatgccggatcatatgatggacttgtcaattccaaagctgacctttcagcctgtggtggaaaattccatccttcatgggcttttagaaaaggttcctaagggaggaaccattgtcattaccggctggctggaggacaacgaagccgttatactgatttccgatgatggggtgggtatggacgccggaaagatttccggcattctctccggcaggggaaccagtaaaaatgggacaaacattggagtattcaatacccaccggcgcctggagatcctttacggccccggatacggcctcacctataacagccttttgggaaaaggaacagaggtggagatcaggatttttgcataaacagaaaagcaggttccgaagaacctgccatccggggtataattaattttgcaaatcaaagctctgtttccagattcttctttaaagccgctaacacaaggcagcctgcagcagaaccgataataacggccagcaggtatccaaaaggatttccaatggtaggaaggacaaagataccgccatggggggcacgaagggtgcagccaagagccatggaaagaccgcctgctactgcggaacctatgatacaggaaggaattacgcggatcgggtcggcagctgcaaagggaatagctccctcggaaataaaggacagacccataatatagttgaccagacctgactggcgctctttctccgtgaatttgttcttaaaaaatgtggtgcaaagggcaacggcgatgggcggaaccataccgcctgccataacagccgccataatgtcaaagttaccttctgccagctgagccgtaccgaatacataagcagccttgttcacaggaccgcccatgtccacagacatcatgcctcccacgacagcgcccaggatgatcttgctggtgccgcccatgccgtttaacaggcctgtgagtccgtcattaattgcgcctacgaaaggattgataaaggtggttaccacggctacaaggaaaataccgatcaacggatataaaaggacaggcttgattccttccagggacttcggaagcttgctgaatgcccttttaagcatgatcacaatgtatccgccgataaaaccagctaacagggctccaaggaaaccggagttcacacttccgcctcccggatttgcaaaggtagcacccatttttgcaatcagtccccctacaaatcccactgccaggccgggacggtctgcaatgctcatggcgatatatccagccaggaccggaagcatcattccaaatgcctgctctccaatggtctttaagtaagcggccagaggtgtgttcttaccaaagttagaaggatcaatggaataatcatcaaacaggaaggccagggcaatgagaattcctccgccgataacaaagggaagcatgtgggaaacgccgttcattaaatgcttatagatggaacggccggcactttcctggtccccgctttctgaggaagaggctgcccctgaatgatggtaaacaggagtctcctggctaaccgctctcttgactaagtcttctcccttttggattccttccgtaacagtggccataaccacccgctttccgtcaaagcgggccatatccacctttttatccgccgctatgatgattccgtctgccccggcgatttcctctcttgtcagggcattgccgactccttctgccccgttggtttccgccttaagagggatacccagctttttcccctgctgctctaagttctcggcagccataaacgtatgggcaattcccgtagggcaggcagtcactgccagaaccctgtaaccattctggacctttgcagcgctttctggtttttcttcttttttcttctgataccgttctgattctttatcatcaatgagccgtaaaaattcttcctttgatttggcctttattaaatcactcttaaaatccggatccataagaagagtggaaagtctggataacgcctcaagatgaacgtcagcctctccctccggagccgcgatcataaacagcaaattggcaagagaaccgtcaaaagcctggtaatccactccctccggcaccactatggcagaaaggcccggctccttaacagcagctacctttgcatggggaatggcgattccgtcaccaaccgccgtacttcccagtgcttctcttgccaggatcccttccttgtatccggccgtatccttaagccttccgccggcttccattaaaccaaccagcttattaatggcctcttctttgccggaaacttttactcccagctcaatactttcctttttcaacaactctgtgattctcatcaaaacccctcctttgataattcttcatacagcctcataatatcttccttgcctgcaagcccctctgaaaaagcactggcgcttcctgcggcacttccaaggcgcagtgcatgctcaaagctgccgttttccatataaccggcaataaatccggccaccatggaatcccctgcacccacagaattcttcacctttccctttggcactcccatccggaatacttccccttcttcggtaatcaggatcgctccgtctcctgccatggaaaccagcacatttctggctcccttttcctgaagacgttttccgtactggatgatctctccaggactatgaagggttacgccgaacatctcacctaattcatgattgttgggcttaatgaggaagggatggtaagaaagtacattaataagcaggtcctttgttgcatccaccacgatacggactcctcttccgtccagagtctccatgatccgttcatagatgtcatcgtcaatggactttggaatgctgccggataaaaccagcacatccccatgggttaaatggtccagcttttcaaaaagcagctgtacgtcttccccggtgatttcaggccccatgccgttaatctcagtctcttcctgggacttaagcttcacattgatcctggacaaaccctttttgacacggataaaatccgccccaaatccaaggcccttcactccccgttcaatctcctcgccggtaaatcctgccacaaagccaagtgcggtattttcataccccaaagcccataaaactgcagatacgtttagtccttttcccccataatagatgctttcctgctcagttctattgactgctcccagtgcgaagtgatctacccttacgacataatccaaggccggattaaatgttacggtgtaaatcatatgtcacctctccttttatatataaaattttatttcttccctcttttataatataatacgattgctttatttcgtcaatatctttctttaagaaatgttatttcttgaagcatttcaggattttgcacaaattttctatgatattcagaagaaatgaactgttttttatgctgattgtctttttgagtattccctgatcaagttcaaagtatttacccttgtcttccaatcttccttattccaacttttcgtgaggatcatacgaaaaaagcaggtttacatcgtcatcataacattgtgcaaacctgctgtccatctactctctatgcaatttttttaagaaaactttttcttaattgtatatctggcaatctgttctttgagcatctgagcctgtgccgataattcctgacttgtagcagcgctttcctcagcgatagccgcattgttctgaataacatttgaaatctgttctatacctgctgtaacttcttctaaagacgaaaactgcacatcagcctttttggaaatttcagctatatccgaaataatttcttttgctcctgctacaacattttcaagggaagttgccgtgatctccgcaaatttagcgccttcctgtacggaatgaagagaactttcaatcaaaacagtagtattcttagctgcttccgcgctctttgatgcaagatttcttacttcatcagctacaactgcaaaccccttccctgcttctcctgctctggcggcttccacagccgcattaagagccagaatattcgtctggaatgcgatatcctcaatcgtctttataatatttccgatctggcttgaagtttccgttatatcagccattgacttaagaagctcgctcatctgtttattgctgttttccaattctgttccaaccgtctccgccttatcattggcattattcgtgtgcaccgcactttccttgacctggccggtaatttccataatttttgcggaaagctcttccacagagcttgcctgctcaattgccccctggcttaaggactgagaactgtcggaaaactgctgggcaccggttgccacctgttcggcagctatctgcatttcgttaaaggtatcatttagtgaatctaaaatccggcataaatcaagcttaattctattaaaatctcctatgaattctttttcaattgaaatatccagattgcctgaagccgcctgcataagcacctgtgaaatttcattgatatagccgcccaatatttctgaggtttccgtaaagattttagccagcattcctaattcatcatttttataaatgacgctgccattgtcctgtgagagatcaccgtttctcatcttttcggccagacccattacagaatccaccggagcaaggcctttctttaatgtcattacactgaccattatcagtacggctaaaccaatcataccaatacccgccaacgctaaggtaatcgttactactgaactcatagcttcactttcattcaccacaaaagcgcttgaccagttgacatcagtcccggctaaacgaagtgtcttatgaatgaccaatgcagtttttccattagaataagaatttttaattttgccggttaccgattctccgcttgcgattgcctttccgatctcttcataatcggaaacagattgaggcacgctgccaacaattccttcgtctacggtgtgagccatgcaggtgcccttgcttgtaacaatatagctgtatgagctcttatatcctccgtctgcgtaatccagccctgctatactggacacatcaatatcacagtttgcaactcctaaaaattcaccggcctcatttacaatagggcagcttaatgtgatcagccaaacgctttcacctgtagaaagctggtactcatatggttctgtaacatgagtcgataaattttcctttgcgggtaaataataatctgcgtttccatatgtatcaaaatcatttaaaacatcaagtcctgtgccggagccgtcacggaaaacataataagaaagtccgtcaggtgtacccttcataaatttgtctggctcaaacgcataatatgctgaaaatatcttgttattatttaataccccctgtaaagattttaccagcattttatttgcttcttccttgttcagtgtttgatatctctgcacttccaaagataaggcctgggaaaacacgagcatgctgtccaaataggataatacttctttggcattgtcttctgcaatataattcagctctttctccgtcattttagttacggtggtgcttgccaacagacttaagcaggaacacattgcaacaataacgaccaaaattatcattgccatcgtaataggtatttttaccgtaagtctgtttttccatagtattttttcattcttcatcttaatttccccttttaacaattattttcaggcaattattaaattgccctcccattgacttttctggtgtttcttacatctttttcataaataccacaggtttctttaaacgacatcttttctgagtatcagggtattttccttgtcggtatcccttttcccggcttttcaagaactatatcggctcagatgtgtttcttcataagttttcagttacacattataatcccgggatgattggggccctttaaaatctcagacaacctattcgtttcagcagtgccacaatctgtccatcaacaaaaggggatgaagttgacatggaatggtatttcttttccacactctggcagacatacagattttttgtgtcatcctcagtataaacgcaccaggtaaacttgtccaccaatgtacagtaaaatgaaagtaaacaattgcttaaagatttttggtttaaactgaatcatttccatttgcattattgatcctttagccagcgaaatccaacaaaaaaccggtgtcagggcttagatcctgacaccggtttttctgcaatatgaaccgcctggttcaccggcaatgctgatttactttttatcatcggaaatagcgatctcatgacgcctgatgcggtcatgggaatccgttttgctgactgacagaaacagatataatatttcgatcactgtcgtagccgacactctggaaaagcagaactctcccaaaaggagcttttccctggtggccgtggtaatatggtaatcacaggcctggccaaggggagaggaagcattgtttgtaatggcgatggttggcgtatgattttcctttgcaaccgccaccaaggtcatcaaccgcttggaaaagccggaattggaaatgacgatgatggcatcttcttcccttaagttgcaggtataggccatctgggtttcccagatggagccggacactgcagggatccccagttggttgaatttaaaggaaccatccatggcgaccggtatggtattccctactgctacaagctgtacggtcctggcatgctcgatcacagataagatccggtctaactcccctgggttcatcatggatatggtctgggtcagttccgccaccttattggccagaatattctgcagggactgagagatattatccctgctgatgtcattggatacttcaatagaattgcctctttcctctgccacctcttttgccagattgattttcaggtgatgaaaaccgttaaatccgcatctcctgcagaatctggatacggtcgcatcgctggttccgcttgcaagagccagctctgccaccgtcatatcgattatttcacttttatgcgccaggatataatccgcaatttttttttccgcttcaaaaaatgaatcgtagaaagagcagagaacaccggatacgctaatattttcctgcataagcaatccacctcgaactttgtgtaatattatttcatcattatatcacgacatgaaatatattgtaaagggctgcctgcttttcctctctgctctaatcctttttctccagctcatattcccaggtattatggtcatatcccgtgtccttaaggatcttgccgatctcagcaaacatctggctgtccggcagattcctctgccataagcggaaagcctcccctgtgcgtacttcttttgcatcaacaggaactccttcacagtaagccttgttaatatccccatacaatcctgccatcttttccacctgctccttgggcaggttcttaattttattggaaatctggctgctgactacttccgtgagaacttttgccccgtattccttaaagcggaggaggttgtcatctaaaatcccctcttcttctgcccagccttccacatccattgccctggtgttataaaccagccttccatcctccgtccattggagaacaccatatcggcagggagaaatggcaatggagtctgcaaccacttcactgatatggtacgcctcttcactctctcccggctcaggcttatgctttttcgtcctctgcaggtgtaagtggccgcttatgtaaagaggaacccggaaggattccagaagctcaatgacatcctggctgttttcaagggtacagtccgttggatagaggatgctttcctttaataagttgtgatgagcaatgggaattacggttatccctttctcccttgcctcctcaagctgattttccatccaggtcagggtctcttctttgatccttcctccaaccttgttataaggttcatactgggcggagtcaagcatgaaaagccagtttttttcatccagctcataaacatagcttaaagaatcctcatcccggctctttgcctggtcatatccaaaccggcggtaaatgtcataaaactcctgaggatctaccatatccgccgcttctctttcctctccgaaataggttgctgaagcatagttattgatatcgtggtttccgggtatgacaagtacttttacccccttttcttccaggatcccaagtttctgcgccaatgcttcgtggcccgccttttccccgttaagggtcaagtctccgcttaagatcacggcagaaggctgaagctcttccatctcagctgtaaatgcgtccatgagctggggaatgtaattgaccagttttccatcgtccccctcaagcatttcttcaaaagcttcgccgtaatccgtaagctccggagaatagtaatggacatctgaagcaactacaatgactggaggcttgtatacctccgccacttcctctgtttcttcctttacaggcatttccgtccgccctttttttctggtctcgctccgggtctccggttctgttccttcatcacttatttctgtctcaggatttatatggtcttcttcaccggtacttttctcctgctcctctggccttatgctttcttcatatggggtatcggaggtttccttcctgtcacggttggaggtatccagattatccacgatcatgacaattccaaagcacaggagaatcatgaccgtataaatcagggccaggagccagttcttttttcgtctgttcatgttattccacaaagatccctttccacttcctgtcagttttatcctatggaatcataacacgctttccagaatacggcaaccttttctcacaggcaaaacaatgggacatgcccggtcctttcctgtcatttattttatgatgcaaaaatccgccgctgtcacggacggacagcgccggattttcaaatttattcataccatcttgtcattggaagatggttgtttatcccttttgatgaaagaatctgatggagatcaatgaccccgttatgaaaggtggctgcacaggcgtttaaatacaagtcccacatcctggcgaactctgctcccattttctcctggatctccggaaggtggtcattaaaattctgctcccacaaacgcagggtcctgcaataatggcggcgaaggctttccacgtctaaggtataaaactgatggtcgcttaaaatactgatcatttcccgaaggcttggaatggtgcctccgggaaaaatatatttcttcatccacggatcgccggggtattcctttaaggcactgatgtagtgaagaagaagcaagcctccgggatttaatactgcttccgcactttttacgaacagcccgtaattgtcccttcccacatgctccagcatgccgacactgacaacccgatcaaaggtcctgtcccagcttttcaaatcccggtaatccattagttccaccgagaccctgcctgtcagtccctcctctttaatccgttcttcaaatttattcttctgctctttgcttaaggtaattccaactccctgtactccatattccttggcagccctgatcagcaaatatccccagccgcagccgatatccagaagggtcatgtccttttttaaatacagcttctttaagatcctttccaccttattgcactgggcttcgtataaggaatcattttccgtcttaaaatagccgcaggaatagctcatggtatcgtcaagccaaaggcggtaaaattcattgccgatatcataatgggacgtgacttccttctcctgattctttttagactgggatgaaaaaatcagtttcttaagctttccctggtccactgaaaatttacccatttggcccaggaaatgattcaatgcataaaaaaggtccccttcaatatctaagttccctttcatataggcctctcccagcgccaaagaagtactggtcagcaattccctgccctcaatatcctcttttaagttcacgataaacgttgggttcccttccccgatatgataagtctttccatgaagcttaacgtcaaatgggtgctcatcaaatctctgaagaaaggaaattaaaaagttgtctgtcatgtttttcatggcttttcctccaatctgcttttcattccttatgagatttttacccatttttcatgatttcataagctttgtttatgcaaagccctgttttttgccccatcagggccattccgcaagacttttcttttgatctgtgttaaaatttatacaaaaatcacttacaggagcagacgatcatgaacaagcagaatcatttatacggacacctggccgccggattttccattttcgtatggggaaccacctttatttccaccaaagttcttcttgaggcctttacccctcttgaaattctgttcttccgttttctcattggctatggagccctgtggctggcttgtccccgccttttgcggacaaaaagccgcaagcaggaagcccttttcgcagccgccggaatatgcggtgtaaccttgtatttcctcatggaaaactttgcccttacctatacgcttgctgccaacgtcagcgtgatcatagccgtggctccgttttttacagctttgtttgactggctgttcctaaaaggagaaaaacccggcccccgttttctggccggatttataactgcgatcatgggcattatcctgatcagcttccagagagcctccggcatgaagctgaatccaaagggagaccttttggcactggccgccgccgtcacctgggccgcctactccgtaatcacaaaaaaaataggagaattcggccatgggaccgttgaaacaacaaggcgcattttcttctacggccttctgttcatggttcccgcattggcaattctcccctttaatctcggcttttaccgccttgccgatacaaagaacttgcttaatatcctgtttttaggcctgggtgcttccgccctctgctttgccacctggaactttgccgtaaaggagctgggcactgttaaaaccagcgtctacatctatgcagtcccggtgatcaccgtgatctcgtccatgctcttattaagcgagcgcatcagcttccagtctgcctgcggaatcgtgctgaccctggcagggcttatggtttccgaaagcaaggctcagtcccagagattccgccttcggtggaaaaaacaaggttctgctcaaaattaatttcttcatctcccagggcgcatatggaaaggacatattccccctccaccatggtctgctgaaaggatgctccggaaattgagcataccggcagagagtcccccttccactcaaaggaaatgccggtgagaggtacggtgatgccccagcccactgccttaagatagctttcctttagtgtccatatccggaagaagtattgggaatgctcctcctccggcagttcctccatgcggagtctttcggcatcagaaaagaccctccttaagatattgttccggaagggccgtatccgttccacatcgattcccagctccttatccccgattccgcaggccaccatgccatccgtatggctgatattataatggatatggggaaagtccttaagataaggctttccgtgctcccctttcagaatcaccggatgatcctgtgctcccgggccaattccatataaatcccttaaacccatgtgaagaagctcttttcccagctcatgctccagttcccgttttttccttccataggctgtctcataccttgccagataaatccgtaccataccgcttttaacctttatctaaattcctgccctgttccaagcccggttttccaccggacttccatggccgaaatatacctttctcgcgccaagagcgctgatcttctccgcactttttatcatctcccccctgtcccagtaaaccatggacagaccaggataaaacatattcatcaatgcatcacccacaatgacgctttttccatcaatatcaattcctatggaccctttggtatgtcccggaagttccatgatcctggcattgatcccgtaatccttcagccggtctccctctttcaaaaaaaattccgggaaaaactccggtatccggtctgattcatagcttttctccgaaacctcagcaaccaccattcccagaaatccctgataatgaaggggctctgcagcattgtcctttatcaggtctaaatcctgcatatgcagagcgaccggaacgcccaatgccttcttaagataagccgtattctgtacatggtctacatgaccatgggtgagcaggatcagctctacctttgtttttctgcactgagccagtattttttcttccgatccattccttcctgtatccaccagaatggctcttccatgttcttcgatcagatagatgtttacgcttccgcatctgatccgttttatttctgccatctattttcatctctctttcaaatacatttacttctgcaggcaatgggcaggccacaggaatgcttgtattcctgtatccggaaagtgctgcaggggtcataacactattgttcattgtattgaaagaaggccttgtatattcccgattttcccctatctttttctgtatatgcagtctatcactccgttttccgtttcagaggataccagctttaaaaggatctgctttcccgtcttttcaaacagccggacacctccgccaagaagcaccggcataagggtgagatggtattcatcaatgagatccttttccatcagctgattgaccagctgtgctcctccgcagatccagacagcctttccctcctttttctttaagccggaaagaagagtatcaagcggttccccggtaaaccggattccggtcctgtcttccatttccctatgggtcaaaacccaggtttcctttccaggatatggccaggcttccggagaaagttccgtaactacctgccggtaagtgcggtatcccataatgaccgtatccacctgcttctcaaaccgtccatagccgtaatcccccttgtaggccttgtcctgaccgcccagccagtccactccgcctgcctcatctgcaatatatccatccaggctgaccgcaatatataagattaccttccgatccagcacatattccagctggcagtcgtaaggctctctttccacgtgttccctgctgcattccatggcctcttcgcagcccatggacttataaaatgcctgggtctccacagaagagtgagaggagatataaagctttcctgccccctgaatccttgcccattgggccgccatttgaaaaagcctgctgcccgccttcctgccccttaagtcccgggacacatgaaggctggaaagatcaaggtactgcccctccattcccaaaggaacgccttccacggaagcaaagccctttaattttccttccagaaaacagccaaagacaacgcctcctgttgtgacggtatgtttcaggcattttaccaatacctcatattcctcgcccttccattgctccgtaaatgaattctgcttaatcacccagatcccgttttccttccgccagcattcccttacttcctggaaacggtcaaaatcattaaaaagctctatgttcagttcttcttccattaattctctaaattccatgaaatgtctcctctttggacttcttatggcttatagcatatcatcctttgcctctttcatcaattgcttttccaatggggaataaggaggttcattcacaggaccttgtttatataaaaaaggcccggcaggtttcaaatatcagacctgccgggctttccctattttttattatctccggatccggaatgcttccattcccggataaactgcactttctcctaactcttcttcaatacggagcagctggttatattttgccacacgctcgcttctgcttggcgcacctgtcttgatctggcaggtattaagagccaccgcaagatctgcaatggtggtatcttccgtttcaccggaacggtgggaaacaatggctgtataacctgcgctgtgggccatcttaatcgcctcaagagtctctgatacggaaccgatctggttaagcttgatcagaatggagttgccgcatccgtctaagattcctctctttaaacgctctgtattggtaacaaataagtcgtcgccaaccagctggatcctttcgcccaaagcttccgtaagctttttccagccttcccagtcttcttcatcaagagcatcctcaatggaataaatggggtacttatcacacagctttttccagtgctcaatcagttcctctgaagtaaagtgtttgccgcccttgggaaggacatactctccctttttctctcccttccattcactggaagctgcgtccatggccaggacgaaatcacgtccaggctcatagcctgcctttctgatggcctcaagaatcagctcaatggccgcttcatcactgtccagatcaggagcaaaaccgccttcatctcctacagcggtagccagtccttttgactttaatatggaagccaggcagtggaacacttccgtacaccatcttaagccctctttaaagctggaagcgcctgcaggcatgatcatgaactcctgcacatctaccgtattggctgcatgagcaccgccatttaaaatattcatcataggaaccggaagacggtttccggatattccgcctaagaaacgataaagagggattcccatgctgatagccgctgctctggcacaggcaatggatactgccagaatggcattggcacccagtctggatttatcctttgtcccatctgcggaaaacatcgcctggtcaatggcataaatgtcggaggcatccattcctgtgattgcgtaatgaatcactgtgttgatgttatgaaccgcatttaaaacgccctttcctccaaagcgggccttgtccccatcccgaagctccagagcctcaaattcaccggtagaagcgccgctgggagccgctcctctggcaatggtcccatccgctaaatgtacctcagcctctacggtaggatttcctctggaatcaataatttctcttcctattactttttcaatctccagataattcatcattttttctccttttcttttaaatggcttcactatagaaggaatcctttaggggaattctttccagtatccacgtttttatcattgattattgcacagggaatgctgtcatgctttcccggaagctgccatctcatttcaaatcaaaaaatgcgccgccaacacagccatacttcattaatatggcttattccctaacttttatgagttagttactcctaattcatgacatgatcataacacatttttccagaaatttcaacactgacactgataattattactaactttactataaaaaaacttctgcccctgctttatacagagacagaagctttagacttctttagaaattacagaaacgcctgtaatataaaatttataacaaagagaattgtcgccactacaataataggattcagttcatttgccttcttcttgcagatctttacaatgcagtagaaaataaatgctgccgcaataccgtaagaaatgctgtagcaaagtgccataaacacaccggcaaagaaagcaggaatcgcttcttccaactgagtccactcaatctccttaaatgacgaaatcatcatacagccaacaataacaagagcaggcgctgttgccacagatggaactgcactgataaaggaggacaagaatgcacttaaggcaaaacaaactgctacaactacggaagtaaggccggtacgtccgccggctccgatgccagctgcactttccacataggtagtcgtgtttgaagtaccaaaaatggcaccaatggaagttgctgtggcatctgcaaacagcgctttatccatcttggaagagaaccctttgcctgattctaaggaggcttcatcttccgcgctgaagattccgcttctgcggcctgttccaatgaacgttccgattgtatcaaatgtatcggataggctgaaagagaaaatggttattaataccaggggaagcttagccatatcaccaaacaaagaaggaagtccgtctgccgtaaaaattactccaaacgtggttggaagcactgccaaagcttctgaaaaatttacggtatctcctgtttttgtaatgcctaacggaataccgatcaaagtcgttaaaattataccgattaaaataccgccttttacattcaatacagtcaatacaataattaacacaagacctataataaataaaacaagagcttttgttgcaatcacagacattgcaggaacccctgcctcaaaattgatagcacctgcatttaaaagacctatgtatgcaataaagatgccgatgcctccgccaatggcgttctgcaagcttgttggaatggctttgatgatgtacttacggatcctggtcactgtgattaaaatattaagaagaccacagatgaaaaccattgacaaagcctgctgccatgtaaatttcaatccaaaacaaacagtgtaaacaaaaaatgcatttaatcccatacccggagcctgagcatatggtacattagctacaaggcccataattaaagtaccaataatagcagaaatgatggttgccaaaaatactgctccccactccatacctgcctggcttaacgtattaggattaacgacaatgatgtacgccatagcaaaaaatgtggtgatcccggctataatctcagttgtgacatttgttccattttccttaagcttaaaaaactgctccatgataaaactcctttttcattttattttacgagactgatgtttcttaattactactagattataactggttcttccattttcttcaattaaatttaataaaattttaagattctactcattatttttattaatctcattaattagtatgcttaatataaaagagatattcattaatgccgcttattcaagatgagccatcaggggaggcagacaggcccagcccgggctcccgggacattcatagctgtcgtttggatgtttaaaaacccatgaaagcgtacttctccataaagcaaaatgccggagaagtacagaggaatctttttcctttgcacttctccggcatccatgcccaccgaattacaacagccagaagtcagttttatcctttccgtattccagacgaaaccggagtccggcaaagaactcctctaaagccttataaagctcctcccattgttccctgccgtttttgttatttaaggattggatccagcaggactgtttcccgcaggcgtcccttaaatggatcttaaattccaggcccttgctcctgatccattcattgcattccaaaatttcggtgatggatacaattttcatatatgcctctattcctggcccttatactttcttgcctgttcctcaatatattccagatcatcaaaataattgatcttcatggcttcctttacaccctttaaagtccgggccgccgctgcctcagctttgtcgcttccctcttttaatatctgatatacgtaaggaatgttggcttcatattccttacgtcttctgcggatcggctctaattccgcctgaaggacactgtttaagaaccgcttcacctttacatcgcctaaaccgccccgcctgtagtgatctttaagctcatcaagattcttataatcaggaagatatttttcaaaatcctcatccttgcagaaggcatcaagataggtgaataccgtattcccttccacttctcccgggtcggaaacctggatgtggttagggtctgtgtacatgctcatgacctttttcttaacttcatcttctgtatcggataaataaatgcagtttccaagagacttgctcatcttggccttgccgtcagttcccggaagccgcaagcacgccttattatcaggaagcagaatctccggctccacaagagcttctccataaacggaattgaacttgcgcacaatttccctggtctgctcgatcataggctcctggtcctctcccacaggcaccgtagtggcctggaacgccgtaatgtctgctgcctggctgattggataggtaaagaaacctacgggaatgctggtttcaaaattcctcatggcaatctcggattttaccgtagggttccgctgcagcctggatacggttaccagattcatataataaaaggacagctctgtaagctccggaatctgtgactggatgaacagagtacatttcttcgggtccagcccgcaggaaaggtaatccagcgcaacctcaataatattctgacggaccttttccggattatcggcattgtccgtaagcgcctgagcatccgcgatcataataaaaatctcgtcaaattccccggaattctgcagttccaccctgcgctttaacgaacctacgtaatggccgatatggagctttccggtaggccggtcccctgttaaaataatctttcccatgttttttggtacctccagatgtgttgtatcgtaaatccgtagtgcaaagcggacgaattctatcagtcatggggattcccatgactgatagaattcgttcgctcacgggcattctccctatgaaacgggccatgacaagattttcttatgtgcaagcacaatgaaaatcttcttctgtcccgtttcgcactgctcattgctttcgtggatattataccattcataccgtatttgtcaatcgggctggttattttacgtgaaatactccttccgcataattgacggaagccatggcatcccggcagtactggtctgcgccgatggtctttgcatatccttccgtaagcacggcacctcctaccatcactttcacagaagaagcggtctccctaagctgtctgatggtctcttccatgctggggaccgtggtggtcataagagcgcttaagcctaccagctttacctcttcttccaccgcagtttccacgatcttctccggaggaacgtcctttcccaggtcaatcacatcatagctgtagttttccagaaggacctttacaatattcttgccgatatcatgaatatctcccttgaccgtagccaggatgatctttccctttttctcctgtgccagaccgccttccgccatcttctcttttatgacctcaaaagctgccttggcagcttccgcactcataagaagctgaggcagaaatactgttccattttcaaagccctttcccacccggtccaaagcagggatcatctccccatttatgatggccagaggctcctgctcctttaacagctccgttaccgcggcatgggcccggtccttaaggccctttgcaatgctttctgaaaggggcatatcgcccccggaaacgccgcttgccagggaggaagttcccggccttaccgtttcccccaacgtagccacctgaccgctgtaaaccgatatataaccgctgcactggggatctaaatccgccagagtccgaaagctgtaataagaacgcatcattgcttctgaattggggtttatgatggcggcactcaggccgttttgaagggccattgcaaaaaaggtggcattgatgatctccctttggggaagaccaaaggaaatgttggaaacccccagtatggtcctgccttccagctcattccggacccttcttaaggtttcaagagtggtcagtgcccctttgctgtcagagctgaccgtcatgcaaagggcatctatgataatgtcttttttctcaattccatattctgcggccttctcatagattttctttgcaacagcaatccttccgtctgctgtctccgggattccagcctcatcaagagcaagggcgaccacaacgcctccgtaccgttttaccagcgggaaaatggcctccatcacttcctttttcccatttacggaattgatgaggggctttccgttatacaccctcatagcctgctccattgcctccgtattggaggtgtcgatctgaaggggcaggtcgatgatgctttgaagctccttgatcacttccaccatcatggagggttcatctatttccggaagtccaacgttcacatccagaacatgggccccattgtcctgctgggtcaccccttcccgaaggatatattccaggttgtgatcccgaagggcctgcttaaacttggatttccccgttggattgatcctctctccgatgatgaccgggtcatcaccgatcaggaccgcctgtgcataagaagaaaccacagtcctgtttttcttatccggatgcctgacaggaaaatccttacaaagggccaccgtcttttcaatgtgttctggcgtggttccgcagcagccgccgattacacaggctccttcctctgcaatttccttcatggcagccgcgaattctcccgcatcaatatcataaactgttttcccgccttcgcttcttggaagccctgcattgggatttacaataaccggtatggaaaccaccttcatgatgtctgttaaaatgcccttcatctgaatcgggcccaggccgcagttgattcccagggcatcgacccccaggccctctaaaagggcgaccgtggattctacgtttcctccggtcaaaagctttcctttttcatcaaaaatcatggtcacaaatacgggaaggctgcagttttcctttgcagccagcacagccgcctttgcctcatagctgtcgctcatggtctcaatgagcaccaggtccgcgccttccttctctccgatcctaactacctgggaaaacatctggtaggcatcttcaaaatccaaatctcccaaaggctttaaaagctttccagtaggacctaaatcaagtgcaatatacccctttttctttccagccggaaagacagccgtttcaaccgctttttttgcattttttaacgccgcagtcaccacctcttccagatcaaattctgctcctttgtggaatttcagaccattggccccaaaggtatttgtctttatgatgtctgcccccgcttccagataatcacgatgaagctttgtaataatatccgggtgctttacattccatgtctccggcagttctcccggttctaagccgctggcctgcaaaagacttcctgttccgccgtcaaaaaatacgatccgtttctttatctcttctaaaattcctgccataggttcctccatctgcatttgtatcattcatttctccggtatgcacagtccgtctttacacaggattcgcatccctttatctcacagcggtaaggtttcccgctaactcccatgaccgcagtgacagacttggaaggcgtcatgagaaggctgtccgtaagcataatcccgatccttttaggtgtttccagaaccgcagtaatattcctctggcactctaagggaaagtctccgtagccagggctgaatctgggccttaaatacagcttcctgtcctcatactcctgcttcagcttccggttctcttcgtcacaatattcctcaatcatggcagctgcagcagcctgcatgataacagctttgctcatctgcagctttgtatatttatgcaggagcacatcaacccccgcgcctaaagtggcggcaaataagatcacctgttcacaatcggctaagttcctgcttaaattccggcttctggtcttaaatacggtgaaatcgattgtgtcatggtcaagcagttccaggggatatacccggcttatgctttttggggatgcagctgccgtaagctctctgacgcattcttcaatcaaagcatttacggtttcatccccttcatttttcccgtatcccagataccgccggatctcctttcggctgatttccattgatattcctccgtttttcattttaaaacgggcccgactcttttaaaaggagccggacccagattgaaaggaatcacagtatctcagaaaggttctccttgatttttaacgccacatccggcttattcatggaataaacgtgaatggcatttactccgttggcgataaggtcaatgatctgttctgtggcataggcgattcctgcctgtttcatagctgccggattctctccgaacctgtctacaatagccttaaaacgggaaggcagataggttcctgacagctggcagcttcggatgatctgcctcacattggtcacaggcatgatccctgcaaccaccggaacggtaacacccttttcccggattcggtacaggtaattgtataaaatattattgtcaaaaaacatctgggtggtaacaaaatcacatcctgcttccaccttctgttttaagtaatccatatcaatggtcttgctggcggattctacatggccttccggataacaggcagcgccaatgcaaaaatcccctgcctcttttatttccctgatcagctcagaggcgtaattgtattctctcttaacaggagcatcagcaggcatatctccccggagagccagcacattttctattccggcctttttcagttcaccaaggacctggtgcaccttatccttggtggaagaaacacaggtcagatgagccagagccgtcacatggtactcatggtgcaaggcagaagcgatatcaacggtataccggctggttccccgcctgccccgtatgtgacactcatgaaagccggattcagctttgcgatctccgccgccgcccgttccactgattcatatttatcctcggttttaggaggaaatacttcaaaggacaaggtaggcttcccctggctcaatatgtctttaattttcatgctgtctgtctcctgtctttggtctcattattactgccatgcactttgggcacagcgcaccccgcttcattgggcgtaagggtatacccacaaaatgttgcatttatcttttaacactttaccacaaaaaactgaattccgcaatatatcctgtttacgtttcctggctttccatcacctgaggattgctgtaagaaacgtagatcctgatcccatcattggtaagataagcgttgatatcaaacagcccttccataatgtatattccatcttcctgccattcctttgtcctggcctgttccataatggccgggatgctgctttcttcctgggggattccggcgcctgtttccgtaagccttaaaaactcctctaaaaagacaagggaaacctccctgtcctttaaggaagagatatagtcatgaagctcccctgtagccgtatcataattgatatcaacatactggaatacgtattcttcatcgcttggatccagctggctggtcacctcatcctcaaaagagaagctttctactgtctcataataggatataggaccgtcttcttcttcaaaaatataattgtcagaataaaccgctccatcttccacctgatagccatagtctgtctctttaaaaaactgccccatggctgccgcgatctgcctgccgtcagcaggaaaatgaatatagccggtacaaggttctccggaagcttttacttcctcttcttcaagctctgtaaaaccggaatcatcgtagggaaccgctgtttcataagtgctgtaattgcttttatcttccatcaactggcctacggttccaatgacctttggaacggcatttaaaacaaccatcagggtaagaaaccctgccagaggcgccagaggcttcctccccttttttgcctgccctggctgggaaggtctggaaggattatggccggcagcaggcctgacaggcgttctcgtctcctgaggtctgggggataccggtctctgaagcacactcttctgcctggccggactctgggtattccctttttgctgattcccctgagcattccctctctgttggtttccctgcctgtccgtcttgggaatattacgttcttcatcataagagggtcgtctttcatttaaataataatctgttttccacagaatgggccgtcggaccatcctcctgcaccggggacagtaattcatttcgtttaccggaagatcacaaaccggacaaatctttttcatcatccttaatccctccttctaacccagcaccagatgagccactgcaatctcgtcatcctccctgaagccctgggcacaaacctgtatatcataaacgtatttctcttgaaagcctgtaatggaagcaatctccggaatgctctttccttcctgagccaagaccagcacctgatggacatccccaattgtcttttttaacagttcatcgttttggccggaaggttcaaagccagcggtctccttgtcagattccgtgataaaatcttccaaagacagattcttttcattttccttgctgttataataatcctctgaaatctcccaatcctgttctttctctgacattctgccactcctttcctcgggtgtttcaaaaacaggcaggttcatcggaacctgcctgattatgtagcttcataagttttatcttttatttcttaaaaaatccggaatgttgatctgaacttccttgttcacggttggacgatagggctgtccgcctccctgaggaggagtaccctgggcattattctgtccctgataattgggcttagtatagtttccggctccgtagttctggtttccataattctggttattatagttgctgttgttatttggataattctgattattataagccgggttggaataattggcatttccgtagttaggattatagttctggttatatccgggagttgctgcagtagcggctgcctcctgattcacggcctggttctgagctgctgcttttggctgtttatagttaggattggaaaaattcgtcatgaccttggacaccggagtctcagactggaggtccagaccggttgcgatcacggtaatgctggcttcgtcatgagcattctcatcatacattgctccaaaaataatgtttgcttcatctcctgccatctcctggacatagctggcagcctcatttgcttccaccaggctgatatcaccggaaatgttaatgatgacatgagaagcgccctcaatggtagtctcaagcaacggactggataccgcctgctttacggcttccaatgccttttcatcaccctttgccctgccgataccgatatgggcaatgcccttgtctgtcattactgtctgaacatctgcaaagtccaggttaatgagtcccggcacattgattaaatctgtaatgccctgtacggcctgctgaaggacttcatctgctttttttaaggcatccggcatggtggtgcgcctgtccacgatttccagaagacggtcattagggattacgattaatgtatctacactctcttttaaacgttcaataccgttatttgcattgctcatacgggtccttgcttcaaaacggaaaggttttgtcacaacgcccacagtaagaattcccatatcctttgcgatcttggccacaacaggagctgctccggtaccagtaccgccgcccattccgcaggtaacgaataccatatccgcacccttcatggcctgggccagatcgtccgcattctcctctgccgctttttcaccgatctccggcttggcgcctgcaccaagaccttttgtcagtttctctccgatctgcatggctgtaggagccttgcaaaactgcagagcctgcttgtccgtattgattccaagaaattcaacaccagctatattctcatcgatcatgcggttcaccgcattgttacctgcaccgcctactccgattaccagaattcttgccgcattatccgcctcatttatcttaatctctaacaagattatatcctcctttaaccataaacagcttactctataaacctaattaatataatatttgattttcacgaaaatatcaaccattttttaaacaaaattccaagcaaattatgtaaattcatttattcttcacaaacctgtaagaagtgacagtatccgcctcatcatatgtatcaagataaagggtccctgataatcctcccaaaacaggaagctggttctttaactcggagatttttccattcatctggtcattgcttccaagaaaaaccttaatatctcccatgaaaagagtcgcatctccccgggaatcataccggatctggtcaaccggaatttccttggttgataaaagctgggtcaggttcaggatctcactgaagatcttccctttttccaccggcaggggctggtgcagagcgatatgtccgaactgcagccccgtaacccacggaataccgtcaagctttccgctggagctttccacaacgatgccatccttgtcaaaatacatatagctgcccatataggagacataacctaccacggacttctcatagacgatcacttcaacctttaccgggctttggaatacgattttgtagtcctccacaaaagggatctgttcatgctttctaaaacgatccttatagagacaaaaaaccgcattccggtcccagccgtccttaaatataaaatcaacaatctgctccgatgtgtactttttattgccgctcaccgtaatatccctgatctgcagtgacaaaaaaatgactgttcccagaaatatcacggcggctgcaattccaaatttaattcttcttctgctttttcttaaatctttcattccatccctctgatcgctgcaccaagactgcttaagtcgctgcagatgtctacatatccccgttcaatatggtggcactcatggatctcagtcacgccttcacaggcaagacctgcaaccacaagggccgcgcctccccgcagatctgtggcagttacccggtttccctttaaaggataaagcccgcgcaccacagccctttttccttctattataatatctgccccaagcttctgcaactcctttgctgtcccaaaacgtccttcaaaaatggtttctttcagcctgccggtgccttttgatgaggccatgacagccattaactgcgactgaagatccgtgggaaatcccggataaggttctgtcataacatctatgcagtcaggacgccctctcatggatacctccaactggttttcatactgttttatatcagcacccattttttcagtaagagtaagaacagaggttaaatgcccgggttggattccctggagcacaatatttccttcagcagccataacagccattaaataagttcctgcaacaatcctgtcacctgccacagtaaattcagaatcacaaagctcttttacgcccgtgaccgccagcctggaagtaccggtcccatggattttggcgcccatattgtttaagaattcacaaagagtaatgatctccggttcctttgcagctccatggatgacagttacccctgggcatatacagcagccatcagggcgttttccgtagctcccacgcttggaaagggaaaataaatatcggcgcccatcagccgatccgcggacgccagaagcttatcacccttttcctcaatgaccgccccaagtttccgaaaggcagacaagtgcaggccaatgggtcgttcccctatggaacaccctccgggaaagctggtgaccgcattcccggtccttccaaggagcggaccagacagcataatagaggagcgcatgctctttatatacgcttccggtatttccgcctgtgtcagagtcgatgcattaattgtcaaggaatggccgtcaaagccgcatatacagccaatatgctcaagtatccccagcatacagaacacatcctgtatcctggggacattatgaatcactgttgtacctttatggagaaccgctgctgccatcatgggcagaacagcatttttggaaccctgaatttttatctcaccttttaaggatcgtaacccctggacctgtatgactgacaatccggtacctcccatggcttcttatatactatcctatgttaagagtgagagaatggtttcacatcctattatttttccagctttatctggttggaaacgcttaaaaccatgcccatttccatcattagaaaaaggactgaagtacctccatagctgataaagggaagggtgatgcccgtatttggtatggtgttggtaacaaccgcaatattcaaaataacctgtatggcaatatgccccatgacgcctacaaccagcaaagctccgaacagatccggcgcattatccgcaatgagcatgaaacggtaaatcataaaaaggaatatcagaatcacggaaacagctccgaaaagaccaagctcctcacagataatggaaaaaatcatgtcgttttgtgcctccggcacaaaccccatcttctgtatgctctctcctaagcctctgcctaccagaccgccggaacctatggcataaagcccctgaagcacctgatagcctcctgtggagggataagcctccggttccagccataccaggatacggcccagctggtagtcatgaaggatattaagcttttccaggacagtggccattggcccggcaaaagccagtaagcctacccccctaaaccgcaggcaaaaaacggccatttctttttacaggacacaaacagcatgacaaaagcaatcccggcaatgatgattccggagcttaagttatttgccgctacgatccctgcaatcggaagagtcgtcacaattaccagaatcacgccgtttcttgagttaatattccttcccatctgaacgatcagaaccgccagcatgacaattagtgcaatttttacaaattctgtaggctggaaagatagacttcccactcccagccaccttctctttccatttactttacgccccaccagggatacggtgatcataagaacatatgataggacgtaagcaaatacggcaaacttggcgtaccagtggtaatccattttagatattacaatcatgataacaaagcctgccaaagcgatcttagcctgcctcatcatgaaataagcggcgttgttgaatttaagctgggctgcatatgagctggagctgtaaatcatgactaagccgaaaacagacagaaatatcacagtaaataagagactgtaatcataaaaacggcgcggtttattctttttcttcactggccttttttctgccatatcattcctcctcgccaactgctattttattcaaccaggccggcgggcatgaactgcggcctggtgggccgccacgacaccgccatggcattcataatttgacgggctcattgcttctacaaagcccggacgcaatccttgaaaatttggccacgttcttcatagcatttaaacatcccccagctggcacaggccggggacaggaggacgtggtctcctctgttggcatatgaagcgcagacctttaccgcctcctgcatatcctccgcatacattacattggtaaaaccatgtctggctgcacattcggcaattttttccctggtctgacccagaagcaccatgtatttcacttttccgtcaaaggatccgatccattcgtcatactctgagttcttatcataccctcctgcaatgagcagagtcggccccggcatggcctttatcgcctggatggccgcatccggattggttcccttggaatcgttgtaatactttactcccgccttttccgcaacaaattcgatccggtgctccaccgccttaaactcgcggatcaccttctgaatgatttccatgggcactcccatttgggcggatatggcggctgctgccatgatgttttcatggttatggcggccaagaagctggatctcatggatatttacgatctccatcctctctccgtcatggttccaaatgatcctgtcgccgtccatacagtaaccttcttccaaaagctggctgctgctgaaatagactgccttaggcttcatggttttaccaaactcccgcaatacaggatcatcataatttaaaacgcaaaaatcctgaggcctctggtttgatgtaatccgttcttttacttctatgtaacattccatggttttatgacgatctaagtggtctggcgttatgtttaaaatggcgctcacatccggacggaaatccgtgatggtctccagctggaagctgctgatctccgctattgttaccgaatcatgatcagtctttaaggcttcctccgtataaggaactccaatatttcctactacaaatacgtggtcataatatgccttcatgatctcaccggtaagggccgtagtggttgtcttaccattggttcccgtgatcgctgccagctttccttttgcatggtggtaagccagctggatctcactccagaccggaatatccgcctctttcagaacagggacaaaaggggcatccaaggaaatgccggggcttatgacgcataagctcacacctgcaaggtcttccttatgaagctccccaataaaactgaaatcctttctccttctccaaactggagaagcaggtcctccttatgaagggccgcattgctgtcataaagaatcacttcaccgcctgttttaaggatcagcctggatgcggcaataccgctttttccgctgccggcgactaatattttctgactcatatggtttctctctcctataatccaaggtatgcaagcaggcaaagaaccgctgtcacgattgcaaacacagctaccacccgtgtttccgaccagccgctaagttcaaagtggtggtggatgggagccatcttaaaaatcctctttccgcctgttctcttaaaatatgtcacctgaatgatgacggataatacttcgatcaaataaatgaagccgataatagcaatgaaaatagggatctgcatcataaaggcactggacgcaacaaagcctccaagcccaagggaaccggtatcccccatgaacaccctggcagggtacacgttaaagagcagaaatcccaaaaggcttccaaccaccgcaccggtaatgggactgatgccggtattctctccgatggacaccacagtcaggaaggtggccaccagaatggtcacgctggtgcagagcccatccagtccatcggtgaaattcaccccattgtcagtccctattacgataaaaaatactgccggtacaaagagtatgcctaaattcagaaacagccctttttcaaagcctccggtaaagggaatcagcatttcggtccccacatcttttgaatgaagcagataataggcaaaaatgcctgtaatgattaactgccctgccatcttttgaacaggcgtaagcccctctgaccgcttcatcacgatcttgatgtaatcatcaaggaacccaacgataccaaatcccacagtcacaaaaagcacaggaatgatcttcgggtattccctcacatagaacagcgatgtaataataatgctggtcaatatgataagccctcccatggtgggagtaccctgttttttcatatggctttcaggcccttccttgcggacctcctggccgaatttcagcctgtggagaaatgggattacaatgggacacagcatggcgctgatggcaaatgctatgatgattgccagaatcgtttcgttaatcatgtcacacctcaatattttatgtatttgtatttcaaaagtacacagttagtagtatacgtctttttgcctgaataatcaaccatagattcgaaacgccgaagcagttttttcctctgttggctcgattcccaggtatggaagaatattcttgaaaatgtctgcaatgaccggtgcagcaatggttccgccgtaataaatcccctcaggttcatcgatggtaatcagggcaatcacctgtggattatcagccggggcaaagcccacaaaagacgaaatgtactttttcagacttcttggaagtttttcggaggtggctgtttttccgcccacccgatagccgtcgacctgtgccttttttccgcttccttctgcaacaacctgttccaggataaaacgcatggtttcgcttgtttgcggagatataatcccttctttcacaggataggtaaagtcatggacagattctccatccgtgctcacagacttcactccaaaatggggagtaacacggtttccgccgttaataattgcggaagctgtggtgattaactgcatgggagtgatctgaaaagactggccaaaagaaacggttgccagctccacaagccccatatcatcttttttatgcatgatggtagatgcctcgccgggaaggtcgatcccggtttttccctttaaaccaaactgctcaaaatatttatagtaattatccactccaagcctctgccctacgtcgatcaaaacagggttgcaggaattcatcatcccctggagaaaggtctccgaaccgtggcctcccaccttgtggcatctgatttttctgtcctccaccacccggaaaccggggcatgaaaaatggtcatcaagctttaccactcctgattccagccctgcggccgcagtgacgatcttaaaggtggaacctggttcataggtgtcgttaatacagggatttctccacatcttgtttaacaaatcctgtttttccttgtcagttgccggcacttctgcatctacacttagtgtaaacggatcatttaaattaaattcaggtgcatttaccattgccataatctccccattctgaggattcatgacaatgatcgacactctttttgcgccctttttctccatcacccgataagccgcctgctcacaataccgctggatattgacatccaggctgatatataagtcctgtcccgccacaggctcgatcctgtcttctgccgcattttcaatctcaattccggccgcatcggacatggtcaggatttttccgttaagtccttttaaatattgttcgtattttacttccaggccaatgattccctggttatctcctcccgtaaagccaagaaccgtagaagcaagggtatcataaggataataccgcttataatcctcatccaccttcacaccttctaaatgatagcttcggatctgatctcccagagccttgtctacattggtcttaataatttcccttgaactgtacttttctacctttttccgaacttcttcctcttgcaggcccagctcctttgaaaggaccgccacaacctcatctgcctttctgatctggttatgtatgaccgatatggtgcataccgtccggttggtggcaatgaccaccccattggcatcaacaatgtttcctctggccgcttttatggtcctttcccgttcatgaaggtctaatgccatggcaccgtaatgttcagaacggaaaatcattagaaaaataagccgccccataagtcctgtcatggcaagaaataacaggaaaaacaggatggctattttctctctgtgatgtgtcttattcgaactcatgcactgctccatcaccattatttctacagtatatgaatttccggagtttttatgagttctttgaaaaaagttccttattgtgctgtagtctcttcggagggcagcgctgccgggagattggaatcatcatctccttcttccctgttaacgtattcttcagaaggatttaaatactcatccggaaccggagttccgtcttccatggtaggaacttcactggtagtttcttctgtgcctgattcttctgatggggtatctccctgggaagcgctttccgtctcactggttatgccttcctgatccggaagctttgccgcctcatccggcagcggtgaggattccgtatctgtatccggaaatacatttaaataaggaaggatttcagtcatgatcttttcaaaaatctcactggcataggtactgtgaggctgatcctccacatgaggttcgtcaactacaacgtaaaccagaacctgaggattatccgatggagcgtatccgcagaaggataccacgtaattggtcttatcacggggaatcttctctgcagtgccagttttcccggcaactttatatcccaccacctttgcggctcctccggttcctcccggcgcattgacggtcttaaacagtgcttcattgatgaacttggtagtggattcggatactgtttccctgaccaggaccggttcgaccttctttatgacggaaccctgctcattaaggatctgcttcaccacatgaggctcataataggagcctccgttaattacggaacaataggcggcagccatctggatcatggtagaactgaaattttgtccaaaggcgttggtcgcaagatctgtaggtcctgcggtattctgggtatagaccaaagtcttgttgtccgcctctcccggcagatcgatcccggtcttggaaccgaaaccaaagatctgctgatacttgtagaatttttcttttcccatctgctgggcgatccgcatcatgaccacgttgcaggatttcatcaggccttcttccacagtgataaggccatgtccatacctgctgacgcagttgatcttatgtcctcccacctcaaggaatttgttgcactcataagtttcctttccggtaatagccccctcttccagggcagctgacacggtaaatatcttttccgttgaccccggctcgaatccgtcgctgatgcagaaattacgccaggtctggttccaggccacctgggtccccagggacatgatttcctcattgctgtaatgctgggaaacatttgcttctgtcaaaggctgggcatctttattctttctcttgtaatcatccatggcttccttgatcccaagctggcgcagcacctcatcggtgtactccggccttaatgtcctgggattgtttaaatcaaaagccttgtcatttgccatagccaggacctcaccgttattaggatccataacgattacaccaacacgtttgcttcctgtcgtctgctcccattcactgatgtatttctcaacgatcttctgaatgttggcatccatggtagaaaccacggtattgccgttggaagcaggctttatgactctctccaaattggagtcgtcatttaaatagccgtattctcttccgttggttcccataagggtcgtattatagaactgttcgatccctcctgttccatccatgccatccccattggcaaagccaatgacgttgcagcccatggagttatagggatacactcgtttgtactcatcctcaaaccagattcccttaatggccttcccgccttttttcagtgtttctgactgatccttcttgtacttttcatatttttctttatcgtcataagtaagctgctttgcatagcgcacatactgtttatctttcttttcctgaatcagattcatgatctctgtccggtcatagccaaagcaatcggttaaggctgttatggtcggctccagaaaagcttcctggtctgacatgatctgttttggatccaggatcaagttatataccttttcactggttgccagataggtcccattcctgtccatgatgtcccgcgcttaaagggaatggtacggctgtcatattcctgctgagacagcacgatctggttgtaatcttcctttttatttgtcatcagattatacagggtcataactaatgcaaacaaagccagcgtaattaccagaacagtaatcgccagcttttcctgcatataacggggaaataccttactctttttatttctgattttgttagtgtttcgggatatcctcattctgtcttacatactcactttccgtcttatcatagtgaaggatctgatctttattcgcatagaccataccaagttcctcagtagccactttgtacacatgatctaaatcgacggaagtgttgatgttcatttccaatgcatcattttcagttttcaaatgttccagttttgcttctaaaagctcaatgccatgaatattggctgtaatagaggactgcaaatgcagataatttacgcacagacagagggtgcagaccgcagcaacggtcagcatgaccacataaggcaaatccatctgcaaggctttttcacggtttcttctgacctgatggttaactgatggacgacgtttttcttccggtgtatggaccggcaattcaaccggcatggatttacgaacagtgtttccctgtacgtaagtggaattcccataggaacgcatattttttcttgcagccactctctcttcctccctttgtttatcggatattcgcaatccgctttgctacttgctcacagtgtgcccagcttcaccgggcataatctcatagctgcaattgctgcttgtcagttggggcttgcccctattctgacacaagtaagttcctgcccgccatttatgcctttcctacttggaaatgagggtcttacttaatgaggttaaatccgttcaaatacacgaagctttgaactctttgaacgtttgttttcttctatctcttcttctgacggtataataggctttcttgtaatgaccttgcctttgctcttccttccgcagacacagacaggaaaattccttgggcaaatgcatgggtcttcattggtcttaaagctcgtcttcaccatcctgtcttccagggaatgaaaggtgataatggacagccgtcctcccggatttaacaaatcaatcatagtatcaagggacttgcttaaaacctccagttccttattcagctcgatccgtatagcctgaaatgtccgtttggaggggtgtccccccactgctcttatcttggcagggatcgctcccttgatgatttccgttaattctcctgttgtctcaatgggctttacctgcctggcccttacaatgtgctttgcaatattctttgcaaacttatcctcaccataatcccgtatgatccggtataagtcaaattcactgtaggtattgatgatatcagccgccgtctgttcattcctctgatccatccgcatgtccaaaggcgcatcatcttccctgtaggtaaatcctctttcccgcatgtcaagctgaaaagaggataccccaaggtctaggtaaattccgtccaccctttctatttccaaatcctttaataccgtttgtatattttcgtaattgcttcttacgactgtcaccttatcttcataagccttcaaccgttctgtggctgctgaaatagcatccccatcctgatcaattccgattaatcttccgtaagttcccaggcgcttacacacttccaaagcatgtccgccgcctcccagcgttccatctacatagattccgtctggctttacattcaggctgtcaatggtctcataaagcagcactgacttgtgttcaaacatcatataccaagtccttccatagcttccgcgatttcttccatatcttcataggtattggctgctatccatgcatccttgctccagatttcaatacggcttcccactcccacgagaactgcatccttgtcaatccccgcatgctctcttaagactgacggaagtagaatccttccctgcttgtccacttcacaggtggttgctccggccagaaagaacctggaaaactttctggcattggtgttggtcaggggcaggcttttcagcttattttccagggtgatccactcattgttatcatacacaaataaacagccatctagtcccttcgtcacaacgaattcttctcccagctgctctctgaacttcgacgggacaataagacgtccctttgcatcgaccgtatgattgtattcacccatgaacataccaatcacctgcttgtacattggtagggttttggaccactatcccaccattttctaccactttgcaccactttcctccacttatggtttaattctagtacatttacgtggaaatagcaagaacaatttcgtagaaatttcaatttcgtccagatatcatgtaactgctgacagacagccttttatttcttccagaaaatggaaaaaaggcacctcctgaggcagtatgggtggaacacactggtcaggaaatgcctgtttttttcatatttttatactataagatgtctttctttcagccttagttttctttgctgtatgcgactcccagttttgccggcacattaaaattccttctggacacggtcagcacaatggtcaggagataaggcatggcaatgaataattcgttggggaaatagcttccgcctcccacggactgcatataaatggcgatggcttctgtcagcccgaataccacggttcctgcaacagctccttttggattccagttgcctaaaaagcatatggcaaatgcgatccagcccctgccgccgataatattagtggtgaacattcccaaatatcccacagagtaaaatgcgcctgcaattcctcccataactccggccaaaagaacggtaaagaaccggaccgcattcacattgataccggccacatccactgcttccggattttccccggtagaacggatggtcagcccaaaggacgtcttaaataaaaggaaataggaagcaggaatgaggagatacaccacataggtcaacacattctgccggaaaaacaccggtcccatgacagggatctgactgagaaaggggattgcaatctcaggcagagggctgattttaagaggagtggtgggaacgccgaacaataccctctgcaaataggtgcagattcccgctgccagcacattaatggcggtacctgttacaacctgatgctgcttcaaataaatacatactacgccataaacagctgcagccacaagccctgaaagaatcgcagcaaggataccgataaatgcactgccagtcaaataggttcccacaaatccaccccaggctcccatgaggaatatcccttcaatggcagtaaccatcatgcccgaacgctccgcgatcacttccgcaatggagccaaacagcaggggtgtactcatcatcaatgcacgttttaataagcttatgatcataacctgtctcacgctcctttctgaagcctgcgcttctctctcctgttttccagataatgccggaagaaataggatatgataacgaacagcatgacaaatccctgcatcagatcaacaatgcttgcaggaacattgacccctggcattcgccccatgagatttcccatgacgcccagcgccccgaataatacagaggctaaaatgattccaatgggattggcattggccagtatggcgatccctaagccggcggaacccactccgctgttaaaatcctggatcagcatatgctgaacgccgtttacctctgtaaatccggcagctcctgccagggcgccgctgataaaaaatgcggtcacaaagattttgtttgaatcaattcctgacatcctggctgcggaagcattgcttcccactgcccggatccggtatccaagaggagtcttataaagcagcacccagattccgatggcagccagaaccgccaatacaaatccgatatgcagcctggttccctttacaatgaccggaagccatgctgcccttgatatggcatctgtctgggggtattcccccttggattcctttaaaaatgtacgcagcaaataattcatcaccgccaaagcaacataagtggacatcatgctgaccagaaattcattggctttatagcgcgcctttaaaaacccgatcaaagctcccataagacctcctgccagtgctgttgtaaggcatacaaggatcaaaagaagggctgtggggaccttgccgtcaagctgcagggacagggcaatggccgcaacagaacccatataaaattggccctgggcaccgatgttaaataagttggccttaaaggtaaacgcaaaggccaatgcagtaaatataagaggcgttgcctttaaaaacacttctcccatggtgtacttatccgtaaacatggtcttaatggaatatacaaatacttctcccggattgatatgcagcagcataagcatgaggccgcttaagagcaggccggcaatgatggcagcagcatttgtcacgatcatgtccctgatttttgtattcatgctttacgcctccttctcctctttgtagccggccattaacagaccgatccgttctgtgctaagctggtcatggtcatagattcccataaatgatcctttgtagatcacggcaatcctgtcgcaaagctggaaaatctccgacaattctgtggataccagaagaatcccttttccgtttttccgctctgccaggatattattatgaatgttattgatggcacctaaatccagacctctggtgggctggtccatgatcagcacctttcctgcgtttctcacttccctggcaaggatgactttttgctgattgcctcctgataagcccttgatctgtgcatcaggtcccggtgccttgatatcaaattcgtcgatggttttctgcgtgtcattttgcagtttcttcttatttaaaaagccatggacggtccatgttttatcaaagctggtttttaacatcatgttttcagcaagagtcatctctcctaccatggcatcccggtaacggtctacaggaacgtatccgattcccagatcaatccggtcccttacagaagcagaggtaatgtcccgtccgtttaaaagcacttttccggaagtggctggtaagcttccgcagattacttcgcaaagctcctcctggccgtttccgctcacccccgccactccgaagatctcaccttccatgatctggaatgacagatcacttaaaagagggggttcccctttgcgctgtactgtgacagaatccagttccaggcagatcttcctttccttctgcccttcctccagctcccgcttcggggccaccatttcctttcccatcatcagcctggtcagctccacctcattggtatcttttgctgaaaggtctcctgtaagccttccgcctctcataacaatgatccggtccgccacctccatgacctccttcatcttatgggtgatgaagataacagaatttcctctggcagtatattcttttacaaactccatcagggtatcggcttcctggggtgtcagcactgccgtaggctcatccatgatcagcaggcttgtctttaaatagagggcttttaagatctccaccttttgctgcactcctactgcaagctcctccacctttgcatccacaggaatgcgaaacccatactgggccgacaattcttcaacttcctttttacatttttcataatcaatgatgccgtttacattgcctaaaataatattttccgtaaccgtatgggcggataccagggaaaagtgctgctgtatcatggaaattcccagagccattgcgtcttttggggaagtgatcttctgttcttttccatccattaagatctgcccctcatcagcccggtaaagaccatagaggatcttcataaccgtgctttttcctgccccgttttctcctaacagagccagcacctctcctctatttacggaaaaagaaatgtccttgtttgccacaaccctggcaaaatattttgatacgttctttaattcaaaaaacggtgtattcacgaagctcctcctttttaaacgatgagggcggcccagtttaaacaatcctgttttctcctggggcagccctccggtacttcctatttttcaaacatcgcctgtaaatctacctttccatccttaaaatccttgattccctgatcaacagcatccttaatgtcctgggaaatattatcggtataaaccggcacaaagatatcttcattaatacctgcttcatgaaccatatttccggaaagcttgccatccatgtaaagtcccagagcccaggtatagaaattcttaaaatcaaaattaacagaagctacgacagtattgggatcaatggtggtctggtcgctggaaaaaccgatgaatttcgcgcctttcgcttttgctgcctcaatgcttccaagtccaacctcattggcgtatacaaacagggtgtcagctccgttgtcgatcatctgctcggccatctgtttgccaagggctacgtcattccagctgtttgcataggctcttgtagcctttgcgccggaaataccgcggctctctgcgatcttaaccgaattcttttcatatacatccatcaaatgctccataggctcgttggggaagcctccgatggttgcaaagtttccgttctctgtcacatttcccgcaaggatggaagcgatgtagctggcttcatattcctttgggaaaatgggcgccacattctctccgtcgcatttggaaccgtttacagcacaaaaagtagtgttcttataattgggagccaccgcagctaccgcttcatcaaactgggaacctgctgccatgattaagtcgtagccccgctccgcatattcacggaaggttgactcataatcagatgcctgcacgttttcaacatactccattttggtgcccagcttttcgttgcaggcggtaagccctgcatagttggttgcattccagctctggtcattgatcggccctgggaggatgaggacaattttataatcagccgcgctttttcctcctgctttagcctttgtttcagctgcaccctctgtttttccgtccgtaccgcagccgcttagcaccagtgctgctgctgttaccgctgccataagtaatgcgccaaatcttttcttcatacgaagttcctccttttttgcgtctgacccgaataatatctgacagctattcaccactgatatcattcacagacgtttgcgaattgtttgtgataatagattatcatttcctggtatttatcacaattctatcagattactatttactccaaaatattatgttttttgttattatgactaaataaaagaaagacaggagttaatttttagttaatttcccgtctttttcttaagtttatccagataatttaacgcctgttccggtactcaagaggcgtgatcccatatgcctttttaaaggcactgctaaaatatttcgcctctttgtaccctaccatttccgccacatctgccactttatattctacatggtttaaatagaactttgccttttgcatccggtattcggtcacgtattccatgagattcttcccggtatgacgcttaaaaagctcacataagtaattaggagagagatggagctccctggccatatccttcagcgtgatcttgcctccgtaatgaacctcaatatactggatggctttcaccacaagtaaattcccaatctcattttccccatctgccgcctggccctgtctcccctcatattctggggcttccggcaatagctccctttccacctcccttaacacggaaagaagttccctggggtctgtgggctttaacaaatatctggtcactcccagttcaatggctttctgggcataggaaaaattgctgtacccgcttaagatgatgatgcggatatttaagttcctctcccggatctggcggatgagctcaaggcctgagacttccggcatttttatatccgtaatgatcacatcagcttccagttcatacagagcctttaaagctgaatggacatcttcaaataccccggttactttaaaaccttcctgggcttccagcagcttaaaaagtccttttctgattttaggttcatcatccacgatgatcagcttcatatcttgcgtgttctcctttcccttctcctgattccgttacagtccggtgatttttcggtatgcgcaggcttacaatggttccttttctataagtactttctatggcaatcccataaggttccccataatggagacggatacgccggtccacattcctgaccccgattcccgtatggccttccttctccatatcaggcacatcctcccttaagtgccgaagctgttcaggagtcatacccattccattgtcctccaccgtaatgagcatctcatccctaagattttttatgacgattttgatattccccttctgttttctcggctcaattccatgggtgattgcattttccacaatgggctgtaaaatcagtttgggaacttgaacctctgctaagttttcttctgattccacagaatattccagccgttcttccaaacggtttttttggatttttaaataacaaagcacatatccgatttccttttcaagaggtacaaaggcattttcatcctctatgctgtaacgcataagaccggccagggaaaggatgatgtcgctgatatcatattcttcccggtcaatcagcatccagttgacagaatccagggtattataaagaaaatggggattaatctgtgcctggagagcctggacctccgcatttttctgggcgatcttttcctgatacacctgcctgattaaggtattgatctcttccagcatgtaattgaaggattccgtcagttccccgatttcatcctttctcttattggggacacggacggcaaaatctcccttctgcacctgccccattgcctttgaaagccgcttgataggccctgccatggcataaaccaaaaggatgatgacaatggcaatgccaaaggtgcttaccattcccaccagccatatggctttgtttaaatctcctgcctggggaaacagcccttcaaagggtatggctgaataagatttccagcctgttatgccgttatattgtccgcagacataatacttcttgccgttccatatcaattcaaagcgacggatcccccgttcgaaccggtcattgatttcttcctgccatccgttatttatcttgggattgctgcagattatctgacccttctggtctaaaataaacaggtactggtactgaaacaacccctggtttcccaaaagcagattactgaacatatccggatccagttcgatcaccatgacacctaagtttctttcctcctccttgtcctggatagccctgacaacggtaactgcctgttgttcttcccctgacggtgaaaaaagctttggcatgattcctgtccatacaggcttattgtttctgccgcttaaagcctcatcgtagctttctagtgctttctttgaaataaatttggatcctacggtatcagctgttgtatacatcacccgggaggtattaatgatggaaatatccatctcttcaccaaccgatttaataaggcttctgcagtaatcatcaagatacgtacggctgacctgctgatctccctcatcccagccaggagcgcatgcatcccgcacaagctggctggccaccgcattgtcaagaatctccataatatagcggaccttaacattgatattgatatcaatgcggttaattgtatctgacatttcctgctttttattcttttcaacaatggctttgctatgggaaaaggagagactccctataatagccccttcgatcatggctgtgacaataaacaccagagtcaatttcattcggaacgacaagtgcttcattttcccacctccggacatatttcaccgtctgattatcagttttcgacaatacttagataaatattacatccctctgcgaattgtgtcaaattgcttttggttcaatcgcaatttctgctaccctttttttcgtgaataaaggaactgtctgtcatgatatggcattgatgcaaaagcatttatcattggctgtcagctataaatatgttacacttcttttatatccaccgtgtatgaaatgattgaatcctcggtaaaaagaatgaagaacaaataaacgttgttgatgtggggaaaggagtgctgttttatgtggttaggagcaattgttttggattccggcaactcggaggaattatcagatttttatcagaaattattgggttggacaaaggaacggcaattttttgaagatgaaacatggattattgtaaaaagctctgagggacaaggtacgccactggtatttcaggaggtcagcgattacgcaccaccaaaatggccggctgttaaaggtgtccagcagcaaatgcttcacttggatttttatgtgaaagaagcagatttggataaagaggtaagccgcgcgatctcctgcggggcagttttgtcagaaatacaattatcagaaagctggaaagtgatgcttgatcctgcctgtcatcccttctgcatcataccgcttccgccaaaataaacaaaaaaacaacataagaggacgggccgtacccttgtctgcctgcttcccagccaggccattgcgtcccgccctgaaacgacaacggctcccatatgctgtcgtttaaaattctataaacctactgttatcgccagcaaatgcgctggcaaaaaaagcttcccccaatcggctgccggtccggaaagcgaaaaaagcacggaaagagctggaactctttccgtgcttttataaatttgcacataacgcatcacaggcttttggtatcaatagcctgcggcaatatattgttcaattaatttatccagttccacacttctgtgataaataatatcttcatcatcatgctcaatgcttttatttaatctttcccttgcttcttcaatatcacgtattaactcttcttttgacatcatcatatcattacttctcctttgctcttttttcgtatctgtctgtgtttgcagaagagcacaagagtagatatcactaccagaattaatgacagtgcctgagacaccggaatgccagtactaaagaatattagctggtccgtgcggagtccttcgatccacactcgccccaaaccatagccaagcaggtaaataaaaagcatctccccatcgaacctcttgcgtttcctgtaccaaagcataaatgccagcacgcagagattccagaccgattcatataagaaagtgggatgaacctgtatatactctaccccatctcttacgatcatatggttcaaaagctctcttgatatcatattctcattaaccagcgctcttctgattctcatagcaaacaggctgtcggtatatccgccaaacgcctcgcaattaaagaagtttccccatcttcctataatctgcccggttatcaatcctaggcatccagtgtcagccaaggaaaagaaggaaagtttcttcaccctggcataaacaattagagttatgacggccgctatgacacctccataaatggccagccctcctgccctgagatttaaaatttgaagcagatcatccttataattgtcccaatcaaataaaacataatagattcgggctcccataatagagataatgattgcataaagagtataatccagataaagatccggatcctgccccctgcgttttgcatcgcttgttgcaatccaaagacctgctaatattccaacccctatgataatcccgtaaaatgcaatgcggaatccaaatattgagatactgtttcgtaaatggtcgattgtaatccccaaatgaacaaaactaatatctgccgtatttgccattcgtcttctcctttcgatgttttctttattttaccccgtgaaaacacaaaaatcaaacatattcgcccgacatattcgactataattcgacaaagaattgattcttgcgtttttctcttttaattttatggataatatgatattctatattagttgcagataaaaatcaaccataaatataaacaatattaggaaggtaattgctatgaaactaggtattgtcgggctgcccaacgtgggtaaaagcaccttgttcaattctcttacaaaggccggtgcagagtctgctaactatccattttgtaccattgatcccaatgtgggagttgttccagttccggatgttcgcttaggccagctggccgctttatatgattccgcaaaaatcacccctgctgtgatcgaatttgtcgatattgcaggacttgtaaaaggagcttccaagggggaaggtctgggcaaccagtttctttccaacatcagggaggtggatgccattgtccatgtggttcgctgctttgaggatggcaatgtaattcatgtggatggaagtgtggatcccctgcgtgatattgaaaccataaatctggaactgatcttttccgatttagaaatattagaccgccgcatcgccaaatctacaaaaggcgccatgaacgataagtctcttgcaaaggaactggaaattttaaagagaatcaagtcccacttagaggatgggaatctggcaagagggatggagatcgaggatggggatgaacgagaatttatttccacccttaatcttctcaccttcaagcctgtgatttttgctgccaatgtctgtgaggatgacctggctgatgacggggtttccaatgaatacgttggaagggtccgcaaatttgcaaaagaaaacgactgtgaagttttcgtcatctgtgcccaaatcgaacaggaaattgctgaactggaagaagatgaaaaaaagatgttcttagaggatctggggcttacagaatcaggcctagaaaagttgattgcagccagctaccatttgcttggactcatcagctacttaactgccggccctacggaaacaagggcatggaccattaaggaaggaaccaaggctcctcaggccgccggcaagatccactccgattttgaacggggctttatccgtgccgaggtggtgaattaccaggatcttctggattgcaaaacctacagtgcagcaaaggaaaaaggtctggtccgcctggagggtaaggaatatgtagttaaggatggggatgttgttctgtttcgatttaatgtatagaaagtatttaatcgagatcacttattgaaaggccggaacatactggtcagcgccagaaggtgctggccttcttttatgtcttttcttcttatcgcttaatccacggtcattgtgactgataaattgtgtcaataaggagattaaccttgtaaacctattttcttgtgctataatatgacgtggccatacaaaaatcctttttgcagccgagttaaaaagaatagggagcattcaccgatgaaaacatttattaacgcgattatagccggaattgccatcagtataggcggagtaatctatttaacacttgagaatcatatagcaggttcttttttattttcaatcggattatttaccatatatacctttggatttaatctgtttacaggaaaggtttgttatattgttaacgaaaaaccctcctatttagtaacaatacttattgtatacataggtaattttacaggaacagttggagccgggattatatacagacatacaaaactggtaaagctggtggatcacacaagcgaacttgtgaatgtgaaactgtcagatactctgttcagcacttttatcatggctgttatgtgcggtattatgatgtgtatcgcagttatcggctatcaaaccatcaaagacggtattggaaagtatttaactttgatcatgccgatcatggtatttatcctttccggttatgaacacagcatagcagatatgttttattttaccatgggaaatgcctggaatgcaaaagcatttctgtatatcctggtcatttctgcgggaaatttagcagggggaagccttattcctttagcaaaaaaatatcttaatgaagaagcttccctccttcactagaaaatccccgcaaatatcctgctcactgattcaatcaacaagcttttataacgcacattttaataatttggcgttcctgattcaaagcaatctggctataatatatacgataagaaccgatataaaaagagctgttttgattccaaagcttgtaatgtaattccggtaacacctttcaaaaagttttttactcatattttcctcatttcctcccaattttcagtagaaaacatttgatagctcctaccaatactataataaggaacgctatttttttataggttgtaattattgttaatgctacaccatattttcgttacataaaatctaaatgctactttttctgatcgaaaattctgatccatgaagaaatgattattgaccaatgtcactccagcagtttgatttgcagatgattctgcttaacgaggcagcttttaagtctttgtaaacaacaaaaactgatataagatatataatttattttcatgggggagatcacatttcggtcgtcaccccttatttacattatgcgacagattctggtatgtcaaaaagagctgcctttcgacagcccagaaagcttaatatcataacaatttattcgataataaattcttaaattttatttgcgatttcatcggaataaaaaatctaccgccccatgatttgaatttttttattaaaaatgatatagtcctgtgttctcatatgattttccatcacgcgatagggataatcaatttctcaacctcaggcttttccaatgcatcaattggcgtgattcctgctaaatcagagggtatatccaacaatgtggaaatgctaccgccaagctgcttgatataccatttgcccttgtattgtactgcatcaaaacagaaacaaaacttattcccttcaacttcaaagatggcaacgcagctttccactctgtctgcaccgcaaacctttgtccgctgtgctctgatatccagtctgccatcggaaccatattcctctgagagttcctcaggagggacataccccaggattttcatggaactcaaatccaattgattcaacagttctattagttttgaagaaatattttcatcagaaatgtctacatcttccaataaagtggaatctttgaaatatccttcatttataatataaacagaagcatattgttttaccgtatcccgtataatttcttcttttctcctttgaatattgaagcctcttgaaaagtcatttacagcgggcagatcgaattcctgatgcataaagacatatgcatggacattttctaagcttgcctgtaaatcataatgatctacatagctttctatggagaacgcacttatcatctgatctaattcatgagccttaaagccttccagataggcttttgcagccaattgaggggaatcaaatccttctgattcaaaaataatttctgtgagtttctctgcaacaggtgcttttgttcctgactcgaacagatcctttgaaaaatcggttatcatttgcataaatgcctgcccaccttcttcatccagcagtacagttccagccgaatccctatctatatctgccatattggctaaaagcccacccagttccagaataaaccattggctatcgaattctattacatcaaagaaaagggcgtacttattctctcccatttcaataagggctgcacagctttctatattgtcaccgccaaaatttaccgcccgcttgaccatattttttttatgtgtctccgaactatatatttctgggtacatttccgaaggcataaatcccagcaatttcatactttctaaatccactgcctttatctgccccgtcagcttcttcataaactgttttgcgtccccatcttcttttaattgtatgtagctatccgggttcagctccaactggcagaggactatgtattggtgcagaatatcatctaaatacatttcttccgcaaaggtatctgccatgcgtttaaaatcactggacttaagccccttcaggtaagcttgtactgcgctttgcggcgaattaaacccctgctccgctgtctgaccttccttttgagattctggcgtctcagacaattctgtctgtatttcagatacttcctgatgttctgtctgaggttcagatgtttcctgggaagagcaggcagaaatacatgccaacattataagggctgctattattaccaaaatgtgtttacatttttgtgtctttttcatttgttcactcggcctctcctaaatattttatattcattcttatacaactacttaaaaatattgcttgttgccaatcatatctacttctccatagaccatcacatattaatgtatgtatttactgccctaggtctcgttggagtgcctggatattacattggttctttacaaccttacttgtcttagaagaaagttgtctgtatcagtctggattcatgtataaattgttacatttgagacaccatactcgcgactgaggtagtggacagaactaactgcatgatacaaatctactattttcgtgatagccgtgttttaatatacaataacctttacagttcaaatatttcttgaatctcttcttcattccacttttgctgaatttgctgtttgattttatccgataatggcataacttctttccatgtttctgcatttctgaaagatgagacattccactgatttgagccatctaattttagagtatgctttctaagttcttcactatcagagtatatcttctcatcaattagactattatctaataactcatttaaactattattggataaaaatgatgttagccccacaataaattcttcaaaaatattctattctatcatttcatcgacagatgtcttgtactttcaccacattcaccgtaagcgcctatttgacgcttacgataaaccaatttgctttggaagaaaaacttctttaccaaaatggggtcgccgacagactaatactaataaaattcatttaccaattataaaaaacagatgtaatatgagatcactaaattcatcttatatctcctttttagtcatatagcaaattgaacgccattgagttatattaaatcagaccaaaatggaacatgaggtatctttgaataatctatatcattatagtcttttaaaccaaattctatttgtaagtaagaaagtaaatcattaccataatatataacatccgttccgtgtattgaaaatactggatttgatttattatctggataagatggcaaatatctatgtgtaaatatgggtataagtttaggagccgtttttagaaaattatttattacctccgccttttcattttcatctaatggctcttctccccaatcatcacaccaataaacttcatctactagctcaattaaatcattttcaggtctttttagtgctgactttatatgctctatattactaagactaaaatctttccaattataaaaaccctttgaaatcggcaatgccagtgaataaaattcaataagttcttttggtaacataatctcataaatctgatgtattttacttaaatctgtttcatttattcctgaactaaatattacatttttttctttcattatatttataatttcttcatacatataaacctactcctttattgtatttttgtaaaagaagagtaatggtcattagtataccatacagaactatcatcgccaataactattctttcagcacctctatttttgcctttcacgtatggattgacgtcatattccctataacttattccctctggaagtttctgtgcaccttcttctaaaggtatattcttatatgttcgtccacctttatatccagccagtggtgtcccattattattctttacctgattcgctatatcataagctttatctggaattatagagctattctgaattacctcaccagaccccttagcaccaattcccacctcgccagaacctttgttattaatcttatcaccttttattccagcagcattatcttgtctcttagccactccaatattagattcctcttctgtagatttcccctttctattcctcacttcgctcgtacctgaataataaaggagtattgaatacgccatggcatttgtactttctgcaaaccagctgccaaacattttatgtttctcaatggctctgcttatagggtctgtctccatcttctttgcggtctctttacaatccttcttaaatagttccagcattgttgcattcagataattttgattccactctgccttgttacccattttgttctgacacgctgtatcagtcaaatcctccataaatacttcaaatgcttttgtattacagtccaccagcagcctttccatggacgccagcattaaatgcccctccagatttccatcggcatacatgctattgatttctacctctcctccatgggctttcatcctatcctctaaaaaccggagtccctcttcgtacatcccttcttgcagatacaggctaccatatgaatcctgaaggatttccaacaagcccggatatctattttgcatctcacggattaacaatatctgcttcgcatatatcccatcctggcctgatttaataatttcaaattcctcggcagattccctgcatttcagaatcgattttgttgtgataatttcctttccattgaccatggttttttgcggttctggattctcccatttcccttctatttccatcttaaactcacacagatgtcctacatggcaatttccaaaagataaaatgttctccaacgcaatgcaatcatctacacatgctcccggcagagtattgatatcaatactctctttctccagatgtaaaaaactgtcatgagatccatatctacagcgtaacctcgctcctaacaccagtggttccggcggcttcggtggttcctccgcttttttcctattcagccaggaaaaccaacccatacgcttcctcctctcattctaccataaattcctcgatcctcatacccgttacttccctccgataaacgctttccacgaatttcagatcacccactatgtatcgtccctttacctctcccagcctgaaaatcgggcacatctgtatcttttcttccttcaggattccggttatgatctcacttttgtctctgctcagcttacttctcacatccagacagtccaataccggtaaatcaggaatctggtagtaagctgtccgcttgttatccttatcggataaggcagcatatttaaaccggacttccgggctatacaggcggataagggctgcaaattccttggaaaccataaagcagggatgacaaataatatccatgaacgggatttccccattcagttccacctggaaatgattcttcctgaacaactcctcatacacctgtcggtccggtatccctggccttatcttggtataccagttcaagaaacggggttggggattcctgtcgtctgcatatatcctaaaatatctcatctgctgtttcctcctctcccagggtatagagcacatccgcctctcccatgtactctccaaacagaatctttacacgactttccaacctggctcgctctggcaggaagcctttttccggcagtgcctcttcaagtatttcatatatgaacgctttagccagccgatggtaatagattgcataggcatatcggatataatctgtctcatattcacggattctaggaatatgcctctctaattctttcctgatggcttccacctcctcctcaaacagatgatatatgcttccggcatcccagtaagacaccgactgggcggtatcactgtaaaacccacgatccatcaggtctatgcggataagatgccgttttaaaaacatactgttgtatagatgagaaaaaaggatgtagctcacttttcctttttccttcctacctgaaggatcacggcctgcttcgccgcctctctgaacgcttccaggaatgcatgtaccgttcctttgctgttttcttcacagaacaggactatacgcctgctgcttttcgaaaactgttccggtatgatctggttcattgctttcataaattcattttttcggtttttcattgtatcctgaactttccgccggtgaaggtaatatccttatccatatgaagcccggccccgctctgtctgatatccacctgttccgacccggctatgacaagtgaggcatcgctggaaagagtcatattcccccctgaggtgatggatatgtccttattacttatgatctgtatcccctccccatcctttattctgatggacatcccctggttgttcgtcagttccaggctgtctggagtaaacagcagttccttcccatactttgtcttaatggatttatgatccgggttcttcctgtcattcccggtccccatatgtacggaactgataacatatccatgctcctctgtctgatccggaatctgcaggcggacctggtcatcgggttccggcatgcagtaccagcccgatccatcaggtgaggaatatccggtggaataagggaaccatctggtaatctcctgaccggaattttcatcccctgtcagttctattcttaccatatcacgcatcacttccctcacagttgccaggaaggagcagcctgattggaattcattggacgtctgcattacccccatcccatccagcggccgaagagtataggtgttcatcaactcaccatgctggtattcactttgtatcctgaagacatatccgccttcgttccctagcataagcctgtcccacaggtcatagatatcccttgacgggatatggtattccagataatcctgttccatgagcgagcccagaccatttgccccttgtgtcataaaactgtccacatgctttctgacgccgcagcttgtggatggaggcatctggtaggtgtcataatgaacgcttcctatataataaaagactccctccctggtaattgcgggtgtgacagccttgccgaagcggcttgcaatccgactgatgaactcccagtcagtttctttatactgcaataagaagtctatcggcgtcgtctccagtcctccctcctcctttactccagctttaccataggactgatttatacccttcagcacatccagataggtcatgccggtattctgaaaggatcggaaatggactgcggcctccataaggtaggtcccactcttcagtatcagggtaagatgggtggcatgaggccgggtttctaaagaaaaaccggcaattatccctgtcatcaggttccttgtctccccgtcttcatcctcggcggttattgtcacccatatatgttccaataccttccatctgtaatcttttgcatccccatcacggatataaccgctgacagaagctgttgcgtgttccccgactgcccggtctatctccaggctttccaacgtcagaaaatcaaaatgagaaatatgtatcttatcagccttcatttgtttgctccgcctttcctccgatttctatatattccagcgaatgtagtaccggcaccttccattcatcataaaagcgcatcctgcaattgaatgtcccagccagcaaatatatgtctgaaccaatcaggaactgcaggttatatgtctcatcatccagtgtaaaattcttgtactcaaaccacataccttccgcccctttcggacagatgtaccccttatcataaaatacagtctcagatgcatggagccggaccgtattctgcatctgacatataagtccgtccaggttatcatactcccgaatctcctcccgctttagcaggtgaaatccaaaattctcatcgtatcccgcactggtcagcagtaccggcgggcggtaagtgcttatgtatctgacctttacaatcctctccggcatttccataaaatcctctggaatcaaagcatttacctttccttcaaataatagaaacgggacaaaccgcaccatttttccacggatgggaacttcatctgccagcagatcataggaacttgtccttctctggtaaaaatcttgtaagcggataagcttttcatccacatagttcccttttttcatacgattcctccttattagtttccggacctgtaaagcgttccatgattaattttcccatagacaggcacctttaggggaacctccagtgactccatgatctgtaacagttgtctcttaccttcttcatcctctataaaacaccccatggtgccaaacatcatacatccatctaccggaaagacatacatgaagttctgcagcttcccttccccaccagatgtctggaaggaaaaccagccacaggtcccatcctctctcactgcaagctgtggctcgcttaacaggcaggagggataaagactgactatcgcctcagtgatggatcgaatcacgtactccacctgtatcccggccagcttctgttctttcaacagagaaaaagtacaaaatctgcgagtatcctcatcctccaaaataatctgtggcctgtcctcataaggatacatcaattccgccctgccgttttccatcgcccggaagaaattcggaatgcccaccgccagccgtccgccaaacaggagttttttttctttaacgtttcccatctgtcccctccgttttctgctttaattcaccaagctgtttctttatttcctccctgcacctgtcaaacgaaagcttgacaggcttatagatcatttcactatgtcccaataccagctgttccatctgctccggcactctgcttttaatctggcaaactggcaactggttcaccttatcaatcagcgggctttttcccactgctccatttatgacggaatatgacatgttcattccccttccattcttcctgcaataggacggaatcccacagcaatctgagacagcctgtcctgctctatgctttgcggtatggacgaaatgatattgacaatcgacggaccaaactcataggtacctttttcatcctcctctgacagttcctttaactttagctgcagtttttctttttctttcttccttctctcctcttccagattatctccttttgcctgattttccttacggaaaccgggtcctctggctggaatgccggtttttaactcatttaggtttttaaatgtgctgtactcccccatgaaatccaggttatggcagatattcaccacagccggattacccaactgccttttaatagcagtaatctcagtgggtgctctcagctcaatcctggctccatgcagagctacctttccttttgcctggaccagaacctccccgctgctgcggatgatgtctcccacaccatcttgtatggaaatccctgattgtccgccactagtggacaattcaatatctgacggtttgagtgctatttttttctccgaatctgttgtaaaccagcggttgtctggattctgcgtctcttcacacacctgtccgttctgccacatgcagtggattcctaccgcttcctgttcatccccccggcataagaaggtggactctgcttccggtttccggcatgcagtataccatgtttccattctccgggaaccaagggtaaaagtatgccatgccagcatcctgtttttcatcaatatccaggtggattctgattgcctcttctttccgctccagtaccgtaccggtcagcgagatgcctttcatacgaggattatagatagtggggaacatattatggttcttccctgccagcttacaggtacaacgtagaatcccattctgcaaattcaatcttacatgatacggccacaaaatctcatccctgtaactgacacattgccccaaatgaaggatttggattgtgtccacttcataataggcggcttccctggtcctccagtttgccgattttttatattccgcatccatacaccatctttcacacgatacatttaattccagggggactctgctctccgggaatcccaggtatattcccttgccttcataatcacctgctgcaatgacaggagcatgcaggtgagttgacaacctaagaaggaattcccagtctgtttcctcatactggataaaaggcttcgtgacagctttatcttccgcagaacatagtaaattgaaagaattctcccggataattttttggatcaatcctaaaactgtttcattacagttctggaacgatctgcttttcctttccagatccataatccaggataaggaataggccgataggtacaatcgatcagatgatgattccttttctatgcggatcttaccaattactccggaaaaaagcaggagctccttctgatcctttacagaatagatcatgagaggttgactgttatgctcctcgcaggatagatccaggctcccaggctctatttctgccgcgaactcggccatggcatgggtaccaatgccttctctgatagaaagatgccgtaactgacttatcttgatattgcatttgatttttaattcactatctgtaatatactccgccaaaccttcactcctcaccttcccttatccaaaagggaccgccttttcggcagcccctgcatgtttacacgctgtatccgccttccacagcgatctgcgccatcttgtcctttttctgtttgatgatgagccggaatgttcctacaccttccgtatctccgtagttttctttataatccactacaaatgcattgggatatgtatattttctcactacctgagaagctgcaatcacctcaacggtcaccttccggtaacagtcagacttttctgctggtactaaggaccagagtcccaactgtcttgtagaatcaaaaggatctccatctactgcagttaatatctttcctgaaatttccacagtgctccccagatcggtggaacgcgcgttggaatcaaggggaatatctgtcttaaactttactcctgtaatactgatggtccctaagtcaatggtagacgggccttctacttttaatgtaaatcccataatctgttccttcctttcttttattcttcctgattattctccgctgaatccgccttcaaatttaagagaagccattttatccttcttctgcttaataagaagcttaaatactccggttcccgtttcatcggtaaaatcttccctgtaatcaaccacaaatgcattgggtaccgttatctgacgaaccacctgggatgcatttaccacgtcgatctgaacattccggtagcagtctgaattttctgcgggaactaaagaccatctggccagcttgctggtatcatcggcggcctccccgcctactgccgccagtatcctcccttcaatcaacaccgttgaaccaagatctgttgatctggcattggaatcatggggaatgtctgctccaaatactacattggtaatgcttgtctcgcgcagttctaaggtttcactgcctgtgattttcattctaagtcccatattatgtcctccattcttaaaataagtaaatttataatccataaagcctttctgttgacagcctttggatacatattttttaaatataagttttaattactaaccattatttgaaatagtggcgggatattagccctaaaagagctgtatacctgcatgcctaaaaaacttgtagctgcacagcctgagggttaggtctttcatttaaaaataaaaaattcctttgctctacttattttctttcaatatactacacttatcgaatgttttccccaccatgtaatttttaacggtttatatgtaattttgcgaagacggccttttcaaaaacggttgatgatataatacgtaattgcttcctttggaacatttgcgtataaaaaaaagaggctttcaccccatagctgatccctcaactactagcaaaagcctcattcttcatttcaagctataccttccagctatgccaggtttgaataccccattaaactgatatccacttccttagccacttccctgccttctctgatcgcccagaccaccagggattgcccacggcgcatgtctccggccgcaaacaccttatccacattcgtcttatatttcccgttttcagtctccacgttgcttctgccgtttaatttcacaccaaaagcatcagccacgtaattctgcgctccaagaaaacctgctgcgatcaaaacaatgtcagccggaacttccttttcgctgccggccaccggttccatgttcatgcggccggtcttttcatcctttttagattccagactcatgagcaccgcttttaccaccttgccggacttatcctttataaactcctttactgtggtctgatataccctgggatccttgccgaatacgactatggattcttcctggccgtaatcggttttcaacaccttcggccattcgggccagctgttgtccggggtccgcttttccgggagctttggcatcatctcaagctgggtgacagaggcacagccatgacggataaccgttccaacacagtcatttcccgtatctccgccgccaatgacaataacatgcttgccttttgcggaaatatagctgttatcctgcaagttggaatttaacaggctctttgtggtggactttaagaaatccactgcaaaatagataccctcaccatctcttccagggacttttaaatcccttgggtttgacgctccgcaagccaggatgatccggtcataatcctttaataagtctttggtcttatgattctttcctacatcagcacctgttaagaacgtcacgccctcctgcttcatgatctctgccttccgttcaatgatatgcttttccagcttcatattggggattccatacataaggaggccgcctatgcggtcttctctttccagtacggtgacgctgtgccctcttttgtttaactggtccgccgccgccagccctgccgggccggaaccgatgacagccacccttttgcctgtgcggatcttgggcggaacaggacctgccaagccgctttcataagcccgttcaatgattgcatactcattttccttgatgctaaccgggtccccgtttaatccgcaggtacacgcagcctcacagggggccgggcataccctggcggtgaattccggaaagctgttggtctttttcagcctgttgtaggcctgccgccatgttcctgtatacacaagctcattccattccgggatcagattattaaggggacagccggaaaccattccctttaaaatcacaccggactggcagaatgggacgccgcagtccatgcagcgggcaccctggcatttttgttctttttcggaaagaggcagatggaactcgttataattttttatacgagccttgggatctaccgtttttcccgtttttctgctgtattctaaaaatcctgttggctttcccatttccgctcctccttacttttttgtgttggcataaaatgcctcaatctgtgcctgttcactgctcaatcccttttcctccatcaggacgatggtgttcatcatacgcctgtaatcgtggggcatgacttttttaaacctgggcagatattctccaaagttatcaaggatctcttttccctttgcggaattggtgtaagccacatgttccttgatcatttccttaagttcaaggacatcatatttattggtgacctcttcaaaggataccatttccttattgagtctcttataaaaatccctcttttcatccagcacataggcgatgccgccgctcattcctgcagcaaaattcttaccggtagatcccagcaccaccacgcgcccgcctgtcatatattcacagccatggtctcccacgccttctactacagcggttgcgcccgagttccggacacagaagcgttcccctgcgattccgcagataaaagcctttccgctggttgcgccgtataaggctacatttccgattacaatgttgtcctcagccttaaacttgacgccttgaggcggataaaccaccagcttgccgccggaaagcccctttccaaagtaatcattgctgtctcccaccagctctaaggtaaggccccttggaataaatgctccaaagctctggccgccgctgcctgtacagttgatggtaaaggtatcctcggcaagaccttcaggataaagcctggtgatttccgaaccaaatatggtacccaatgcgcggtccgtattggaaacatcaatatgaaggctctttttctggcctgccagcagagcatcttttaattttttaagtataatcttttcatccatggttttagccagttcaaaatcatagacctgtttcttgccgtatcccagaagcttctgtcctgcataggcatttcccagaatagcggaaaaatctacctttttggctctttcagaaggaatattgtctttcttccttaataaatcagtccttcctacaagctcatctacagtatggatgccaagctttgccatatattcccgaagctctttggcaatgaaatgcatgaaattgatcacatactccggctttcccttaaaacgcttccgaagctccgggttctgagttgcaattcccaccggacaggtgtctaaattacagactctcatcatgacgcagcccatggtcacaaggggagccgtggcaaagccaaactcctctgcacccagcatacaggcaatggcaacatccctccccgtcatcaatttcccgtcagtctccagaatcaccttatcccgcagcccgttcatgatcagggtctgatgggcctcggccacgccaagctcccatggaagccctgcattataaatggagtttctcggagccgcacctgtccctccgtcaaaggaggaaatcaggatcacctgggcgcctgcctttgcaacgcctgccgcaaccgtacccacacctgcctcagaaaccagcttaacggagatcctggcattggtattggaatttttcaggtcataaatcagctgggccagatcctcaatggagtaaatatcatggtgaggcggaggagaaatgagacctacgcctgtggttgaatgcctggtcttagccacccatggatatacctttcctcctggaagctggcctccttctccgggctttgcccctgggccatcttgatctgaatctccttggcgctgaccaagtacctggaagtcacaccaaagcgcccggaagccacctgcttgatggcggaacagcggtttataccatcggttccaggtatcagacgttctaagctttcaccgccctcaccgctgttggatttgccgtgaatccgattcatggcgatggccagagtttcgtgtgcttcctgggaaatggaaccgtaggacattgctcccgttttaaaccgtttcacaatggattcttcgctttccacttcttccaccggaatttctttagacttggaataatcaaagtccagaaggctccttaaattaaccgtctgtccctccccggttaaggcatgagaatattctttaaatacctcgtagcttccggttctggccgcttcctgaaggagatggatggtaacaggattgtataagtgctcctcctgccccgcccgttccttatggcttccaacgctgtccagagttaaatccacgtcaaggccaaggggatcaaaggctgccgagtgcagaacatccacgtcatttgcaatatcttccagggcaacaccttccaccctgcttaccgtatccgtaaaatatttgtccacaaccttctttgaaatgccgatggcttcaaaaatctgagccccctgataggactgtatggttgatatccccattttggaagcgatcttcacgatgccatgaagaactgctgcattgtaatcttccacggcagcataataatccttatccagcatgccgttttcaatgagcgtacggatggactcctgggcaaggtaaggattgatggcacaggctccgtatcccaaaagggttgcaaagtgatgcacttcccttggttccccgctttccagtataagggccacggaagtccttttcttcgtcttcaccagatgctgctgaagagccgatacagcaaggagggatggaatgggcacatggttttcgtcaatatcccggtcagacaggataatgatatttgccccatcccggtgaacccggtctgcctccaaaaacagcctgtcaatggctttttccagggaagtgtttttatagtaggtaatggggatcacctctaccttaaagccagaccttttcatatttttaatctttaatatgtccgtacaggtaagaatagggttattcaccttcaatattttgcagttttccgcttcttcttccaggatatttccttcctcgcctacataaacagtggtagaagtgacgatctcctcacggatggagtcaatgggcggattggtaacctgtgcaaagagctgtttaaaatagttaaacagaggctggtgctttttgcttaaaactgccagaggactgtcaactcccatggcggaaaccgcttccgccccgttcaaagccatggggaggatcattgtcttgtattcctcataggtataaccatatgtcttctgcagcttcgccctttcctccttgctcatggcaggaacccccttattggggatcggcagctccttcagctcaattaaattggaatccagccattctccgtaaggctggcgtgccgcataatattcttttaattcctcatcgctgatcaggcagcccttcaccgtatcaatgagaagcatcttgcctggacgaaggcgctcttttctcaccacatgactctgttcaatgtcaatggctcctacttcggaagccaggatcatctggtcatcatcagtaatgtaatatctggaaggacgaaggccgttacggtctaaaacagcgccaaccaggtcaccgtcgctgaacacgatagaggccgggccatcccagggctccatcatggtcgcatagtaacggtaaaagtccttgatctcctgggacatggatttgtcatgttcccatggtgccggaatggtcaccatgacagacagaggaagatccattccgctcatcatcataaattccagcgcattgtcaagcatggcggagtccgaaccttcctgattgatgataggaaggaccttgtgcatgtcataccggaagtactcggattccatgttctcttctcttgccatcatcttgtctacattcccgcgaatggtattgatctcgccgttatgtacgatgaggcggttgggatgggctctcatccagctggggttggtgttggtgctgaaccgggaatggaccactgcaatggctgattcatagtccttatcctgtagatccgtaaaaaactttctaagctccttcaccaggaacatgcccttataaacaatggttctgctgcttaaggaaaccacataggtattgtcgttgctctgttcaaagatccgccttgaaacataaagcttcctgtcaaactccagtcccctggctgtatctgccggcttctttacaaagccctgggcaatgcagggcatacagtccaccgcctttgcgccgatcagctccggatgaatgggcacatctctccagcccgaaaattcaaggccttccttctttacaatgatctcaaacatctttttggcctggtttctggcaagctcatcctgagggaagaaaaacattcccacaccgtattcccgctcctctccaagctcaatgcctaagggctttgttacctttttaaaaaatttatgagagatctgaagcatgattcccactccgtctcctgtctttccttccgcatcctttccggcacggtgttccagattttctacgatatgaagagcctgctccactgtcttgtgagtctttatgccttttatattggcaaccgctccaatgccgcagttatcatgttcaaagcggggatcatacagccccggcaacgctgtcttattgggggattttaaactcatatccataatctcttcctttcctttgcttttgagtactaacgcatagcagtaaattttagttgataatactacattttttccctcttgtaaataaattttatttggcaattgtcagataattcgactataatgtatttcaaataatatattctcaaaattataactgtaaacagctttttatctcatgatatcacacaattaagccggcaattaaaaaacctggaacaaacttctaattttttgaagttctagcctttaatagttaagtcttcgattcattttcaaaacttttctgctgccagcgccctatattacgctttttttccatagaaaaagccctgggaatcatcttcccagggcttatacaattttctttcataaataaaaaacgaaattacatctctccaagaccgctttcaattgcttctgtcatggtcttcattgcagctgcctcatcttcgccgtcacagatcaatttgatctctgttccgcacttaattccggctgccataacgtttaacacgcttttagccacgatcctcttctctccgtgctcgatgattacatcggatttaaatttcatagctgtttgtgacagcacccctgctggtcttaaatgaagtccggatggatttactacggtcagtgtttttgataacataagattttctcctttatcctcaatttttttatactccttgcagttaattctattacaatatccaatttgtgtcaagacaaaccatatgtcttttgcatattttccaaaggaaatatcctgcctaggaggtcttggaaagagcctgtctttccttctgggaatagacacagccgcagtaatcctgccggtaaaggccgtactctccagaaagctctacagaccgcttatatccgttctttttcttaaaatcagaaggcagataagcaacccggtactccctggccagcttctctccgatctcattgagcttgcctgcattctttaaagggcttatggagagagtggtagtaaagtagtcaaaacgtccggcctgagcaacctttgccgcctcctgaaggcgaagctcatagcatttaaagcacctgtttccgccttccggttcatgttccaggcctcttgccatccggtaaaattcatccggctcataggcccctgtttccatggtaacgggatggataaaatgcatggacgaaatgagcctttcctgctcttttacccgccttttgtattcctccggcgggtatatattgggattatagaaatacacggttatttcaaaatagcgggacaaatattccagcacatagctgctgcacggcgcacagcaactgtgcaaaagcagtctggggacctttccctcttcctccaatcctgcaatgacctgatccaattccttctgataattcctctggttcatggtagctccttccctgctattgcaaagcggacattggcaatgaccaagggtcagcccctccgttctgctgcctgctcacagcgtccccgacagtgccgggaggccttgccccgcttcaccgggcatgaatgcagcctgctgcgttccaatcacaaaaaggcgtctgcagtagcctgccacgcctcctgtttcctataggaaatccctgatccgtttgctgcggacaggatttctaagctttctaagggcttttgcttctatctgcctgatacgctcacgggtaacattgaactcttttcccacttcttccagtgttcggggatggccatcctccagtccgaacctgagcacgatcacctgacgctccctctcttttaaatctccaagcagagcatcaatatgttctctcagcataacggactccacattgccttccggagtcaccacattgttatcggccacaaagtctcccaaattggaatcatcctcttcaccaatgggcgtttcaagggatgcaggttctctggctatctgcatgatttccatgaccttgtcctcagacatgtcaagggcttctgccagctcaatcacagacggctcgtatccaagctcaagggtcagttttctctgcatcttggacattttattaatcgtttcaaccatatgcacaggcacacggattgttctggcctgatctgcaagagctctggttacagactgccgtatccaccaagtagcatatgtacttaatttatacccttttgtataatcaaatttttcaacacctttaataaggcctaaattcccttcctgaaccagatcaaggaaactcatgccgcggcctgtgtagcgctttgcaatgctgactacaaggcgcagatttgcttcgatcaagcgctctttggcatcatcatcaccatccgcttttctcttagcaaggcgcagttcttcctctgcgttcaaaagtggtaccgtgccaatttcctttaagtacatgcggacaggatcttccgttccaatgccctccaataagtcaatggcgtcaagatctatatcttcctcatctacatcctttataaagctgtcatcaagatcatcatctaaaagcaggtcgtctgacatgagcgcatcatcagttaaaacggaatcatcaatgaccggaatcacgtctacgccgcgattctccaggtacgtataaatctgatccatttgctcggttgtcagttcttcccccataaagaagttattaatctccgttacatccaaagcattgtgcttcgtttttgcaagttcgacaagttttcccagcttatctaaaaaattatccttttccacttaataacgtcctttcgctaagaggtatacataaagctcacacaacttttcattatatactaccggaatacatatttcaacatatttcttccaaaaaaacagctttattgttttttcgtcacttttctcataatccggatttgtttctttaaatttatgatattaacttccctcctggtcccgccgaattctccatctaatacccagtcaataggctcttccgagagaactctcaaagaccttgtccgaaatttatggacgtattcgttaggttcttccttcagaaacatgtagttaatgatgttggtcagatccagtggcgtcttgggcgttcggattaacagcacttcaaactcaccgtcgtcaagagctacatcctgtgccacaagccctttaaaacctcccacgcttatggtgttggttatcatgccgaaaataaactcaccttccagagtcagttcctcacactcaacccgcatcacgtaggactttatggaagccaggctcttcatgccttccagcatataggcctgatgccccagaacattcttcttatcctgaggagttaaataggatacctctgtaaaagctccgaaagctgcaatatatacaaaatgcctgtcctcgcagaaacagccgatatcaatgggaaagggttcgccgtaaaccgccgattcagctgcccttaccatatttttggaaatttttaagctggaagcaaaatcattggtggaaccggcgggaatataccctaaatccgggaaatggtccaatttcataagaccgcttatggtttcatttaaggtcccgtctccaccgctgcacaccaccagatcagcgctgcctccatacgccgcagcagcttccattgcatcgccgcaccgctgggttacatggaccgacagttcataacctgcctttgtaaaaatatccaggatatccatcagcttattcctgatctgagctttccctgaacggggattaaatataaaaagaatctttttcattatatcacctgatcaattttgtatacgctttaaatgcacctggcagggaataatttttctttaagtcctctacagtgacccacaaaaagtctccggccggccgttcttcaagttcaacgcgaaatcctatcatatgccattccacatggctgaacacatgctttgcggcaggaagggatgttattacagctgtcttcactcccagccgggtgagcagcgccgcctcttccaagtgtccctccatattggggaactcgtaaagagaagccaaaagcccggtgtcttcccgcttacgaatggcgatccgcccattctgccacagaagcatcaccgtcttatcctctgccctgcgggcctttttaggtgttttcaccggaatctcaccggtaagcccctttttcctggcaacgcagatggaagccaggggacattgtccgcacaggggctgcccattgggcacacagacaatcgctccgatctcaataagcccctggttataagcactggctgctccttccggcatgacggcccttaagtcttcttccatacggcgtttgacctgctgctttaaaatatcttccctgctgcccgtcaccctggaaaccacccgtaacacattgccatccactgcaggaacagggattccaaaggctatggagcaaatagcccctgcggtataggacccgatccccggaagctttttaagctcctcgtaggacgccggaagctctccgccgtactgctctacaagaagctctgctgttctctttaaattttttgccctgctgtaatagcccaggccttcccagagtttgagcaaccggtcttccgatactgctgccagatcccggattccgggcaaggcctccataaaatgctcaaaataaggctttacagcctccactcttgtctgctggagcatgatctccgatatccacacccggtatggttccggacggtcccgccagggtaacgccctggcgtgctctccgtaccaggataaaagagggcgctccatggctcttaagcgctcacttatatccagttctttttcctttggctctaaagcctgtaacttatcgtaaagcgaatggttcttcatcacacatatccatagattccccggacagatacctctccagaaatcacatgtcttacctctcccggttccacttccacaagaagctctcctttttcattaattcccagagccttgccaatataatcacctgacttatccaggactttcacttcttttcctgcattggccatatgtttattatagacacttatcagcccggataaatcaccctggctgataaattcttcataatattgttcaaaagcctccataatagcggcaatcagcctgcttcttcccacttttccccctgtttccaggagcagggaggtagccgtccgattgacctcatcaggaaattcctccatattgacattgataccgatccctactaccacatagtggatcccttccagttcagcgctcatttccgtcaaaataccgcacagttttttcccgtttgccacaatgtcgttaggccacttgatgcctgcagcaagacctgtcacgttctttatcccgtcataaaccgccagggccgccaccagcgttatcatggaagccgaggaaggaagaatgtccggccttaagatcaggctcataaatatattctttccggaaggggatacccaggtacgccctcttctgcccctgcctgcattctggcagtccgacacaactaacgttccactggatgctccttcctctgccagacgcctggctcttacattggtggaatcaatggcctcgtggtattccaccttcctgccgaatgttcctttaatgcagctttctatctctgttttcgtcattatatcacaagaaccgatgaaatggtaccctttatttctaaccgcctcaatttcatacccttcttcttcaagctgacgaatggctttccagattgcagtcctggaaacgccgaagcgttggcacagctcctgcccggataagtagccgtcgctttctttaagcagcttcaggatctctgttttcaacgacatcacccccaccagacgctcaccgcactgatcacggtaaggacggttaaaaggatcccgaacagaaggaccgccatacccgctgccttcttctttttttcccttccgctgagcctgattttatagactccgttgaccaggttaagcgcgccggccaggaaaaatattgccggaaacaaaagcatatggtcttccggacttaaaaatgatatgactgccagcactacgatcaggattcccaccacaatatggaggatatccaccaccatggaagcatttctcaaacttcttcctcgttcctgtatatacatgttctactctcctaacgttgccaccattaccgccttaatggtatgcattctgttttctgcttcgtcaaataccacagatgcaccggattcaaaaacctcctctgtcacttcattccctttgacagccggcaggcagtgcatgaatatggtagtgtctttacctgttttttccatcagctccttatttacctgataaggctttaaaagagcaattcgctgggcagccttgtcctcttctcccatggaacaccacacgtcggtgtaaatggtatcagcagccttaaccgcatccgtatcctctgtgagcgtgatggtacttccgctttcctttgcataaccctggcataattccaccaggtcctccctgggccacaggctcttaggtgccaggatggtaaaatgaacgcccattttgctcattccgatcatcaggctgttggccatgttattgcgtccatcccctgcatatacgaaacgaagtcctttcagataaccgaaatgttctttcatggtgagaagatctgccaggatctgtgtcggatgataatcatcggtcagtccgttccataccggaacacctgcatattttgccaagtcttccacggtcttatgcttgaatccgcggaattcgatcccgtcaaatacccttcccaaaactcttgccgtatcttccacgctttccttgtgtcccagctggatatcatctttacccagatactccgggtgggcgccctcatccactgcagcaaccacaaaggaacatctggtgcgggtggatggcttttcaaaaataagggcaatattttttcctttcagggaagttcctgtgatcccctgttttttcttggcttttaagctggcagctaagtccagcaagtatccgatttcttccggtgagtaatcctttaatgtgataaaatttcttccttttaagttcatattgcatcctccgcttttctggttgtatttttatacattattatagtatattacgtatagttatgcaatactttttttatttcttatcatcctgctgtaacggctttcccttgtcaagggaccggaacttctttctgatctctcccatcagctcatccaccgtgtatatttgaaagcgtttgacctttaggcgctttgccatatcctccaaaagtcccaggtacatatccttgtaatcccagtcctccttcagcttaaactcccctgccagcctgggaaacagcctttccgtaaatgcccggtatcccgtcagagccgccatcccctcctcatttaatgtgtcctgcatatatattttaaaaaactcaagttccgacatcattttatcgaagtaataaggttccgtattaggtgcatcaatataataaatacgcccgcaaaggccatataagaacctttttgcatcaaaatatcccaaggtcatgttttttctggcctgttttttatcaaactccaggattcccccaagatcctgccttggagcgatgtggtaaacccggatcccttccgggatctccgtgacccgctctttatcaagaccaaggccgtagatgcggagcacaataatatcttcatatccgtgatccaggagcacgttaatgggaacattgttgactcctcctccatccatataccgctttcctcccagcttctcatttttaaaagccagaaaataggcactggcaagtagcatatccttgatggttcctgcttcgctgtttctgatgtcctcagccagttctttcctgtcagaaaccgaataggttacggtataaagctctctgtccgagtttctgatcttttcctcatctcccaccacttcttcaatgagatttcttaaaggagtgatgtcaaaccctccatcctttaagatctggaatccgctgcttatcagctcctgaagatttaaggacttaaaatccctttcccttaacgcctttatggtctcatcgtttaccgccatgacccgggaatactcaatgttcttccatatcttttccgcccgttccagatcatccatgcaaatgagagccccgtttaaagatccaacggaaacacctgcaactcccttgatctttaccccagcctctcttagagccttccatgcgccgatctgataagcccccttggcacctccgccttccagcaccagtccatactccctgtttaaatccagtttcagttccataagcccctcctaagcctgattcatggggagtaaagcggacattcgcaatccgctttgctacttgctcattaacgcaggctacctcgcagcctgcgtttaaattatgccaaaaacgcagcaagagggcatctgccccctgctgcggtatattgatagcttaaggaaattattcctccggattcttggagatctccgtaatggaagaaaccagcccggccatactctgaatctcggaaggaataataatcttggtcgccttgccgtcagcaaccgccttaaatgcctccaggctcttaataactaaaaccgaatggtccgcaccggcttccttgatcatacggattccatccgcattggcctgctgaatctttaagattgcttccgcctggccttctgcctcacggatccgtttttctttctctgcctctgcgcgaaggattgccgcctgcttttcagcttccgcgtcaagaatggcggattctttctttccttctgccacaagaacggtggatttcttctctccttccgcccttaagatggcttcacggcgctcacgctctgccttcatctgcttctccatggcatcctgaatcgctgccggaggcatgatgttcttaagctctacacggtttaccttgattccccacgggtcagtggcaatatcaagggtctctctcatcttcgcgttgatcgtctctcttgaggtcagtgtctgatccagctctaaatcaccgatgatattacgcagggtcgtagccgtcagattctcaatagccatgatgggattttccacaccgtaagcataaagcttcgggtctgtaatctggaaaaatacgaccgtatcgattctcatggtaacgttatccttggtgataaccggctgaggcgggaaatccgccacctgctcttttaaattgactcttttagccacccggtcaaggagaggcatcttaatatgaacacccacggaccatgtttccaaaaacgctcccaaacgctctacaaccagggcctgtgcctggggaacgatcctgatacaagatgacaataatgccagaataacaattaatataataatgaccgctgaaaatccaattgctcccatactatgcttcctcctgattctcactcacaattaattttacgcctctgatttctttcacttcaaccatagtgcccaccggatatatcctgtcatcttccagtgctctggccgtccattcctggccgtttaagaccgcagcaccttttccctctgtgttgttgatcgtggccgtgactctggcactttttccgatcagactatccatattggtttttaccgtgttccggtttacatactttaaggcaaaaggcctggtaaaaaacaaaagaacaaaggatacaattacaaataccgccagctgcacctggatattgattccaaacagtgccagcacaaatgcaaccagtgctcctcccgcaaaccatatggtcgtcagagccatggtcatagcttcaattcccagaagcactacaaatgcaataagccaatagactgctgccatctcatcattccccttccctgccattataggcaaagctgcccggcaaatctatccgttgacatacgttacagttcctccatgccgtttataatccggcaaatagaacatatttcaaaaaagcgcatggcttcactactactatcatactatatgttccagtatttctcaacatttcagcctgtaaaaagccttacaattttctgacgattatatccgccgctgtctggcagcttcaaacatcagcacagaagccgccactgccgcgtttaaagactccacctttcctttcatggggatcttcacataggcatccgccaggactgccgtcccctctgtcagaccgtttgcttcgtttcccactaaaaaccctgtatcaacagtataatcctctttttcataattattcctgccatttaaatgtgccgcatacagtctgatcccaccggcttttaaagcctttaaagaggcgggaagatcttccgtatatgcaaagggaacgcggaagatggagcccatggtggacctgataaccttcgggttataaatgtctgccgtggcatcgctcatgagcacgccggtgaccccggctccttctcctgcccttaaaatcgttccaagattgcccggatcctggatgttttccagaaccatcaaaaaggcagggccgggagctgccagcaaatcctctgccctgtagtcatactgtctgacaagggctaaaatcccctgaggcgtctgggtatctgacatgatcttaaacacatcttccgaaacaacttcgtatttcattccggacaaaagctttttatgggcttcatcccttaaaaacccttccgatacaaagaggctgtcaatcctgtccgccggaatttccttaaacatgcgaaggccttccgccacaaagaggccgcttgtctttctggctttggccttctttgataagttcattacatgctttacccttgcattggcgctgctggttatcataacgtacctctcttttataagttttccagttcttcaagccacaggcggctcacagcatcgcttggcatgcgcaaatctcctctgggggaaactgcaacggaacccaccttgggcccgtccggcatgcaggaacgcttaaactgctggctgaaaaatctgcggtaaaatacctttaaccattttaaaatgacttctttctcataatgtcctgaaaaagcataaaccgccatgcggtaaaccttttccggcctgcagccaaaccttaaaatctggtaaaggaagaaatcatgaagctcatatggccctacaagatcctctgttttctgggcaatctcccctccctttggcggaagaagctccggacttacaggcgtatccagaacatcaaacagcacactgcttaaggcctcttccccgcaggtgtccgcataatagcggactaaatggcggaccagtgtctttggtaccgaagcattgactccgtacatggacatatggtccccgttataggtggcccagccaagagccagctcagacatgtcccctgttccaatgaccattccgtttaaccggtttgccatatccatcagtacctgggttctctctcttgcctgggaattttcataggttatatcgtgaacatcgctgtcctgtccgatatcccggaaatgaagagttacggcttccctgatgttcacctctgtaagctctgctccaagggtcttagtcagggtgcaggcgttctgatacgtccggtctgttgttccaaagcagggcatggtcaccccatggatctgctcccttgggatctccagcatatcaaaggcacggaccgtcacaagaagggccagcgtggaatcaagccccccggaaattcccacaaccgcatgcttacagccggtatgggcaagcctcttttttaatcccatggcctggatggagaggatctcctcacaccttcggtttctttcctcctcattgtccgggacaaacggccttggatcaatgaatcgttttaactccagttcttctttcttcatttggaagggaatcaccatataatctttgtggttggccgcaggaaaggtggtcatccggcgtctttcatgaaccagccgttctaagtccatgtccccgtatacggtttcatttccaaagcgtttggattccgcaaggagggaaccgttttccgtgatcagattctggcctccgaacactaaatcctgagtagattctccctctcctgcattggcatagatgtagccgcataccagactggcggaatggcccgtaataagacttctccggtaaatatcctttcccgtggtctcatcactggcagagcagtttgcgatcaccgtggctcctgcaatggcatggcggatggacggcggatcgggaacccacgcatcctcacacacctcagctgccacaataagctggggaatggtctcacatgcaaaaagaagattggctcccatgggaatttgagtctcctcccattttaccatcaccggaatttcgttccccggctggaaataccgcagctcgtaaaattccgaataattgggcagacatgtctttggcacgatcccaaggatttttccgttctgaagggccacagcagtattataaagctttccgccctgttcccagggcatgccgataaaacagagaagatcatggccccttgttgcttttaagatctctttcagctctttttttgccttttttaacagggcatcctgtccgaataaatcgccgcaggtataggcggtcaggcaaagctccggaaacaccatgagctttacatgattttcaattccttcttttatctgttcacagatccgttccctgttaaattccgggtctgctacttttacatcaggggttgccgcggcaacccggatatatccgtgtttcatctcttttatctcctatctattgatcggtgtcctttggtatccacctggcttttaagctgtaaatgcagtccatgagcatggtagtgatccatgttataggataacaccacatgactgctccaaaactggggaaaaatggtaccagcagattgatgtagatcatgcgcagaatacacatgtttcccacaccgatgagcatggaaaccatagtccgcccgctgccccgtatactgcccattaaaatctgatgaatggctaaagtccagtaaaacggaaggagtatgagcatggtggaatacccataggaaatgacatcctgatccggtgaaaagatcttaaggatatgctttgcatttaaatacaaaatgattgatatgattgccgtataagccatactaatggcaataccctgaaacattccctgttttacccgcttcggcttccttgccccgatgttctgccctgtaaaggtggtagcagccatacagaagctttggagggggagcatggcaaatccatcgactttactgtaagcgccgaaacctgccatcgcagcggcgccatagctgttgacgttcgcctgaacaataacattggacagggaaataatggattgctggattccgctgggaatgccaagctttaaaatgcggaccatcatcctcttgtctatccggatcttttgcggaaccagctggtaaatatcatctgttttaattaaggcccggacaatcagcacggaagatactgcctgtgcaatgaccgtcgcatatcccacaccttctgttcccatgccaaaggcaaccacaaaaacaagatccaggacaatgtttaccacagaggacactattagataataaagaggacgtttggcatctcctaccgcccttaagataccggctcccatattgtaaacgagattaaacagggatccgcagaaaaatattcttaaatacgccacggaactgggcatgaccccttccggcgttcccatccaggttaagatcagaggcgacatgatcagtcccacaacgatcagaagcacacctccaaccaggctcaatgccatactggtgtgaaccgcccagtgtaactttctcccatcccttgccccataatactgggatataatgactcccgctcctgtaccgattcccataaacatgccaatgatcagattgatcagggaattgcttgagcctacggcagccagggcgtcgcttccgataaaattgcccaccaccacggaatccaccgtattataaagctgctgaaacaggtttccggccagaagaggcagggaaaaagccaggagctgcttccagattaccccttcagtcatgatgatctggtttgtacctcgattctttttcacaaatatcctcccttctttttccaattccccaatgaatattagtatacatccattttcagaaattgggaagccggataatttaaggtttactttttatgagaattcatgtacaatatttttatatcctactaaacagataagaataattaggaaggagagttgcagccatgaaattttctaccaagggacgctacgctcttcgtatgatgcttgaatttgcacttcatccgggtgaatgcacaaagatcaatcaggtggcagaacgtcaggaaatatctgataaatacttagagcagattgtcaccatcttaagcagagccgggtatgtaaaaagcagaagaggcgcccagggtggttattatcttacaaaggatccttcggactataccgttggcatgatcctgcggcttgcagaaggaagcctggttccagtatcatgtctggaagatgaagtcaatccctgcagccggtcccagatctgtgccactctcatggtgtggaaaaagctggatcaggctatctccgatgtggtagacagcattaccctggcagatctggtggaagaacaaaaaaggctggatggtcaggccagctattacgaaatttaaactatggcagaaaaaagttcgtgtttcttccccggcatgggagaacccgaacttttttaatcctctcaacaggtctggggaccgatcaggtgtactcctcttctgtttccctgatcactccctgcattttgaattccggtcaaatatttcacaaaaagcacaatggttttccagaaaaagatccaccagaaaagggtcaaagtggctgcccctgccctgggtaatgatctctgaactcttttcatgggagtaaccttctttatacacacgttttgaccgcagggcatcatacacatccgcaagggccatgatccgcgcagataatggaatttcttcccctttcagcccttttgggtatccgcttccatcccatttttcatgatggcagagagtaatctcttttcctgtctcaatgaattcgctttccgtatccttttctcccacgctggctaaggtctggtatccaatggtggcatgggttttcatgatttcaaattcctttgccgttaattttcctggttttaacaggatagaatccggaattcccacctttccaatgtcatgcaaaggactggcctgggtaatgttgtcaataaaggcctggtccgcttcctttcggtacacgcccttttcccaaagcttttctgccagaagccggcagtactttgccgtcctgacaatatgttccccgtgtcatcatcccttgactccgaaagctttaccagtgcatggatggtcgccatctgggaagcggatacctcctccacctttttctggaccaaatcttccagatggtggttatattcctctaacttctcctcaacggccttagcaccggtgatgtcctggatcgttccatgaactttgaaaggccttccataagattcctttgacgccacaaaccggatatgtacccacttgatccggttcgcctccatgagcagcctgtaccggtactcggcaggcaccatgccgttttgcatgtcacggaaaatccggtttaccagctccttgtcatcaggatggaccttttgaaaatacagcgccagatccggctctgctgaccggtctatttccaatatccggttcatggtatctgaccaccacagctgctttgtggaaaggttcagctcccagttccctattaatgcaatttcctgggcttcccggcgggaggcatcgcttatctccaattccctgctctttatttccagctgctttgatacgtccacataccgctccatgatctccgataccagggcagtatgaatctggttatccacctgttttgcaaaatgatccagcatggccttcacatattcatcagtatctgactcttccaatacaattttttctcccagtaggattgcatctgtgcccatcaatttccttcctcctctagaaaatagtcgatcccaacgttgttcagttccttcagccgcttgattacgattttctgtgcggcaggggtatcaaggatgcttccatgctggggagcgatcatggaaacatcaagattctcgattcgttccagggcgtaccggagtgctttttttgacggcatgatccgctgatgaaaatttaccattcccttgatctggcacacttttttagtaatgggacagacctgttggggcgtgcagtccatgcagctgctgccgatcaatgcaaataaattccagttgtgatcatagcttccgaaaatatcgctgctgaacaatattttagtcttaacatcataagtaatgaagctgcccggcgaatgggaataaggcgtcctgataaattccaggcgcctgccgcttgtaaattcatagtgaaagcctaattcttctatacattgtttgggcgtgttcatagaataataattgatgaaaatattattttcatgatgggagatgatttttaaatctttactgttaatgagagtttcaatatggggaatgttgccgcacaagtcaggatcataatgctggtatatgagacgcctgatcttaccggggcttattcccgtgcgcatgaccttcagcatgaccgtgctgaaatcatccctgcttccgctgtcaatgagaactgcctcatccccgtccacgatcaaataaggattgcagtgaagccctgctccttcgtcaaaaaatcccacccagtagactccctcggctatttctacatactctttataattcaaatcctgtttatccatctgcaatgtcctccaatatgtgatcggcgttcttttccattccttctttgatcctgcacagcaaacggatcctgccatgaaaatattacattatatgacataatataccatatttgtcctttcaagtccatttcttccaccctgcccttttaaaataagcggatttcagttctgttccattcgacggcagtactgccaacgttgaaaagcaaatgagaaaacagggcaaaaaagaaaaaacagcagcacagaggcccgcaggtcaaaacctgcgggcctctgctttaatggtgatcacacgtaaatctataaaaacagctatcccttccgtctagaaaaatttagccgcatagccctggataaaaattgcaagaacaatgaccggaagaacgtacgtcacgtaagcccttgcccatcggggaaattttatcccctttcccgcattggcttccttcatgaatttctcaaatccccagccatatctgctggtgcagaaagccagatagatcaggcttcctaagggaagcaggttattgctgataataaaatcttctaagtccagcacattgcttccttccccaaagggcataaagccgctccatacattaaagcccagcacacagggcagggataacaggataatggcagccgcattcagccacacagcctttttaatggtgcagccggtcaaatccgtggcaaaagaaacgatattctggaaaaccgcaattatcgtggaaattgccgcaaatgacataaaaagaaagaacaggcttcctatcagccttcctcctgccatgttattgaacacgttgggcagtgtcacaaaaaccagctttggcccctggcccggctcaatctggaacgcaaagcaggcaggaaaaataataagtcctgccataaaagccacaaaagtgtctaagaatgccacactgatggcttcgccggccagcctgtgttccttgccaatgtagcttccaaagattgcaagagctccgatcccaatgcttaaggtaaaaaaggcctgtcccattgcagcaaatatgacttccccgatcccagcctccatgatctttccgaaatcaggctttaagtaaaattccagccctgccctgctgttttccatgaatatggaatgaacggccagtattgccattaagcccaaaaggcataccatcatccatttagtgatcttttccacaccgccctgaagcccttttgcacaaatagaaaagcagcccaccaccatgaggatcataaatattcccatgacaacaggatttgccagcatattcccaaactccccggctactccttccgcgtcaaggccaacaaaatccccctttgccatcttgaagaaatacaaaaccatccacccggaaaccgtggtataaaacatcatcagaatgtaatttcccgccattcccaggtacttggcataatgccatttgcttccttcaggctccagcacatcataggacaaggcaacgcttttctggctggcccgtcccacagcaaattccattaccacaatgggcagtcccaaaataagcagaaacacagcataaatcaaaacaaatgctgctcctccatattgtcccacaatataaggaaaacgccatacatttccaagtccaatagcacatccagccgaaatcaggataaatcccaggcgggatgaaaacttttctcttcccatctctttaaactcctcatcagtccattttatctgtcatcttttcaaaaaagagccgtcattttttattccgcacccctcttttatatgaaaaggcaaaagattccatgccattatagcatagaatctttttgacgactaccatatcttaatgacggaccgggtaaaagagagttctttcagctgaccgtgttttccgcaaactttctgatttcagaggcattggtcattttctgaatctggccgttctttataaccaccagggtaggggcctgcataattccaaaccttgtggcaagctctgcattttcttctgcatctaccacctcataatccatattctgtaaaaactgctttgccatccggcaattggggcaggtttttgttgtaaaaagataggttcctgccgatatctctgcctttttcaccgtcatcttatccctgatttccccaacagctccttttttcagcacagagcggccgggatcgtagacggtacggtttttgtattcctgggtctttccttcattccagttttgtaccggacggtaataaccggtgatccggctgtatacctcagctttttttccgcagaccgggcaaaccttgtgctcaccggaaaggtatccgtgttctgcacaaatggagtaagtgggggacaatgtatagtaaggaagtttaaaattctcagcgatagtgtgaaccagctttgcggctgcttcccagtcaggaagcttttcgccaagaaatgcatggaacacggttcctgaagtgtaaagggtctgcagctcatcctggatatcaagagcgtcaaacacatccgtcgtatagtccacaggcaaatgagaactgttggtataataaggggtatctcccggtttgcctgctgttataatctgggggtaatgctttttatcatgctttgccaaacggtatgtggtggattctgccggagtcgcctccagattataaaggtcgccataggcctcctgataatctgacagcctttccctcatgtgatttagcacattctttgtaaactgctgggtcctttcacttgttaaatcttctcccagccatctggcatttaagcccacctcgttcattccgattaagccgatggtggaaaaatgattttcaaagctgcccagataccgtttcgtataaggatacagcccctgattcaaaagctttgttatgacttctctcttggtttttaaggaccgggccgaaatatccatcatatgatccaggcgggtgtaaaaatccgcttcgttcttggaaaggtaagcgatccttggcatattgatggtcacaacgcccacggaaccggtgctttcaccggagccgaagaatcctccggtctttctcctgagctctcttaaatccagcctcagacggcagcacatgctcctcacatcgcttggttccatatcgctgttaatatagtttgaaaagtaaggagttccgtatttggaggtcatttcaaacagcagccggttattctctgtatcagaccagtcaaaatccctggttatagagtaggtgggaatgggatactggaagccccgcccattggcgtctccctctatcatggtttcaataaaggccttattgatcatatccatctcagacttacagtccttatacttaaagtcagcttcttttcctccaacaatggcattcagctctgccatatcggctggtacggtccagtccagggtgatgttggaaaatggagcctgggttccccagcggctgggtgtattcactccaaagataaaggattcaatgcatttcttcacttcccggtaggacaaatgatcggcctttacaaatggagccagataggtgtcaaaggaagaaaatgcctgggcacctgcccattcattctgcatgatccccagaaaattgaccatctggttgcaaagcacggataaatgttttgcaggagaggaagtgatctttcccggtattcccccaagtccttctaaaagaagctgttttaaagaccagcctgcgcagtacccggtcagcatggataaatcgtgaatatgtacgtctgcattcctgtgggcattggcaatctcctggtcataaatttcagacagccagtaatttgccgtaacagctccggagttgcttaatatcagccctcccacggaataggtgacagtggagttttccttgacccgccagtcttccacctttacatagctgttcaccacagccttgtaatccaggatggtatccttcatattccgtattttttctctttgttttctatataaaatataggcctttgccacatccgtatatcccgcctgctcaaggacgtgctccacactgtcctggatctgctctaccgtgacttctcccccgacatcttatcctggaaatcagcggttacacgaagagacagcagttccagtatttcattgttatactccttctgggtggccttaaatgcttttttaatcgcttccgtgattttattcagactgaattcagcattttccccatttctctttactacctggatcataaagactaaactcctttccactttcctgccctgttttttggcatagtgccttttatcagaaatctgataagcggtctttgataaatatcattatagcagaacaaaaacaaaaacacaatatgtagtttggttttttaacaccaatccacatattgtgttttattattcatcaaaaacatcggcattgtttgccagagaggcaaacagctccgatggcacataggcgttcaccagaatcccgtcttcctgatattcttcctttaacagctggccgtatttgcggatcagctggatctttcctgcatccttataggggtaaaccttttccagatacactttctgatttctaagaatggtctccaaaagatttaaaagctcgtcaaggccttctccggtttttgcggatatcctcacctgatgatccgaagatatatccctgaatatcacaccgtcttctgctgcatcgatcttattaaacaccgtgatcatgaccttatcacaaactccaagctcccttaaggtttcgtatacaacatacatctgcatgtccatctgcggattggaacagtccaccacatgaaggatgatatcactgtatttggcctcttccaaagtgcttttaaatgcttcgatcaaatgatggggaagctttctgataaatcctacggtatccgtcaaaagaatctgctgtccgcccggtaagttcaaattcctggtagttggatccagggtggcaaacagtttatcctcagccaggattccggcatccgtaagcctgtttaacaaggtggatttcccggcgttggtatacccgacaatagcggcagcaggcacatggtttttatccctctgctgcctgaccacctccctgtgccgcttcacatcctctaattcagactttaacatcccgatccggtcatggatcagacggcggtccatctccagttttttctctcccggtccccgggtgccgatcccgcctccaagacgggataaggagcttctaagccccaccagacgggctgcccggtatctgagctgggccagctccacctgtatctttccttctctggtaatggctctggaagcaaagatatccagaatcaccatggtgcggtccatgacctttgtgtccagggctccttccagattccgcagctgggccggagaaagttcatcgtcacagacgattccggttgcgtccagctcccagatccggtcctttatttcctcgatcttaccttttcccagataagtccccggatggatcctctcccggttctggatcatcttatccacggtgacggcacccgctgtttttaccagctcctccagttcatcgagagatccttttgcatcatccccatccccggtactgactgccaccaggatcacccgttcctctatttcttttaactcaatcagttctgccatcaatcactccaacctatcttgtctttaaaaatgtgatctcccgctcggcttcctcatcaggaccatgagcggaaatatactgctgcatcaaatccagggctgttttaaattcgcctttatgttcctcggcaacagcctggttaaacaaaagctccggaacctgggcgctgtccggcgcagaaagacctttcttaaaatattccgcagctccatcccagtcctcttcggccagcttgcataagcccatccggttgtaaagctccgcgctctgttccccgtcctgaagggcctcttcatagaggctcatggcatcggaaaccgttccttccttctccatggcagcccctgcagccaaaagtgctttcagcctgcccggtgcctttttttccgtatccagcccggcgcttttcttataatcctcaatagcgccctttagatctccggctcctgccttggaaacagaacgcatattcaaatattccggcagttccccatccaccttgatgagtatgtcataggtgtctgctgaggaggtataatcgcctgccaggtattcggcttctgcccggtactttaacacatccacatcaaacttccccaccagtcctttggaggaatcaatggctttgtcaaaggcttccacggcaccgtcatagttgccctggttaagtgcctcgatcccggcagcccggtaagaatatttatcttcctttttcccgcagccgcctgccccgatagtaaccgccagagccagtccaaggatggcagccatatatcctgtctttcttctcatgctattatctccttttaaggaaattcgattcgccttctgctcacaatagaaatgttattgttttcccgtgcttccatggccgccccggtcttcatgtcccagggtcttcacttcctcaaagcacaaggccggctgatgctccataatgcggaactggcagattcggtcatttatatgaatcactgtatcccggagggcataagccgggaaaaaccactggtcattgtcaccgcaataagtttcatcgatcacacccatgctgttggtctggatcacgccgtaatttttaaatgtgctgcttcttggaaccacatgggcttcaaaccctgcaggcagctccatggcaattcccaatggaatcagcttaaagtcccctgctttcatctccacttcttccgccgcgcgcaaatcaatccagtcagatttgccctcaatatagcgtaagcgttcgattttatcagtaaaatattttattcttatgtcttttgtcaccttgtttcctcctgaatgttatcttcttttttatggtctgccggcattaaatccccgctttcggaaagctcttcttccacttccatgcgtatctcagccgcaactaccggatcggccaccggaagactctgggtggagccgatgccgaatcttcttaaaaattcctctgtggtggcaaacaatgccggccggccgggtgcatcaagacggcccacttcatataccaggttgtattccaccagcttattgactgcatgatccgacttaacaccccggatcttctctatttcgagctttgtcacaggctgcttatatgctatgatggacagagtttccagaaccacctccgtaagaacctgctttttgggcgcagctgcaacgcggattaagttttcataatactcagaccgtgtgcacatctggtaactgttctccagctccaggatctgcatccctctttttcctgtatcatagcgcttcatcaaacgaaggacagcttcctttgctgcagcttcatcctggccgatggccgcggccaaagcctttagttcaacggaatttcccatggtaaaaagaaccgcctcaattacggcttcccaggttttttcttcttttgtgctctttttcggtccaatggtctcaagagtttccttatccatcaatttcctctttcctgccagtcttctccgggcataacggtatccctggaaggagtttcttctcccagatctgacaaatccagttccccgtcttctccttccggctccagggtttcgatgaacatatcatcaaacaaatgctcctgggtcagcctgatcttgccgatcttcatgagctccagaagcgctaaaaatgtcacaacaacaagggtccggtccggctgctgctcaagcagcctgcggaaggaaaatttccggtgctctctggcataatccatgaccgattttatcttatcttccaggcttatggattccttctgaatgttgccgaaccggcttcggataggatccacccggtcagacttgcgtttcgtaacagcccggaaaatctcctggagctttgccagagtaaggccgtcaagaagcttgtccaaatccaccggcggttcgtaccttgccacctcagggggaactgaaggggtcttgtacagcaggcggtctgcccccaattcccggtccctaagttcctgagacatatatttataatatttgtattccagaaggcgcgccacaagctctgcccttgggtcctcctcctcgccttcctcattggtttccctgggaagcagcattcgtgcctttatatcaatgagggtcgcagccatgaccagaaactcgctgacaatgtttaaatcctctgtttccatgtgattgacatagtccagatactgctccgtaatctcagcaatgggaatatcatagatattcaccttattcttgtcgatcaaatgaagcagcaaatccagcggaccctcgaaattatccagtttataagagattcccataaaatcctccaaggcagactaacgcatgcctttgaccagtatatcaaatccttcctcatctgtaaatatatggcaggcgcaaaatcatgatttcgtttttaaatccaccactaccagttgcggtttattgtttaaacgaatgttgatggaatgggttccaagccccctgctcacgatcatatgcctttcgccttccgtaaactctccggcgcagtatgggaggaaaaactggtattgaggtgtcataacccctcctaagtaaggaatccttatggtacctccgtggtaatggccggacagagtcaaatcagctccccagcctctgcactcactgaaataaagaggagaatgacaaagcagaatctgaaaccgctccctggatgcctttcccgccttttgttcaatctcctcctcagtcaaacgctccggccggaatttccggtaaactcccggttccaaatcgatcccggtaacagccagatcttctccataccgttccgtccggttttccagcattttgacaccaaacctttttaagctgctcacatagtcttcataagcgctgccgtacactttaggctcccaaagcagccggttctcatgattgccgttgccgcaaaatacgggatacttaccggccagtttttccataagctccagcgccgcatccgtgcttgccctgctcttactgaagatcatatcgccccctaccagcacaagatcaggcgccgtctcatccacagcagccaaaagtctttcattgccgtcgccaaaccggtgttcgtgcaaatcggaaaggaacacaagggtacggtcctttcttatcttttgacttttcaaaacagttctttccacggaaagctgttctttttcatactcagaacgcaaatacaagcctgcacctatggcgcaaagggctccggcagcaaaccacatccgatttttcctcttcttccctcattttttccttattttctcatcatacaatgaagagcctgtctgcgtcaagactaagaggtccagttgcccaccagatattcgatgataagattgggcacgaccaccataagcccgatgccaatgctcatgacaattgtgccgcaaaaatattcctcatagcctggcgttcccggagtcgggggcaccgtaaaggcaaggcggtagatggcgctgcagagaacagagaagcagataagataaaaaatcacgttaaaaatattttttttcatttatgtattcctcctttcccataatataaaccacttatggataatatgcaatactggataatcacggtttaattaagaccagaggtgataaatcatgatcgtttatgacagactttgggaaactatgaaaaagaaaagcatcagccagtaccatctgataaagtactgcaaggtcagtgccggacaaatcggacgtcttaagaaaaataacttcgtttccactcacaccattgatatgctctgcaagatcttagactgcagcgtggaagagatcatggagtaccgggccgatataagcgaagccacccaaaagacagaatgcccgcctgaaacagaagaaagcaattctgccccatcagaggatttggcatagaaaaagagcccaaaggctctttttctatgccaaaatatccatgttcctaccggatccaggcgcctgaagaatcaagccggtatccatcgggagtaacggtgtccttaagcatggctccatctgcgcccagataaaaccatttcccgctgctttctacccagaaattttctgccattacagaatctgaaccaaaccagtaatagactccgtttattttttgccactcattgcaggccttgtttccatcctgcttttggtaataccatttggtcccctcctggatccatcccgcggacgaaactgctgtccctgttcctgccgccttcaatgcaaatccataatccaaaagagactttgtatccccataatgagttgatttactcttcatgatgaccgcaatcagccgtactccgttcttttccacacaggtaaccagggtgttgccggccagtgaagtataaccggtctttccgccgatgactcccggataatatctggcatcaccagggctcagcatcttatggcccatggtcacggtcctggccgaagccttttttgtggccggtatctgatagcttaaggtggatgacacctttctcacgatgtcattctggaaagcagccctggcaatgagcgccatgtcatgagccgtggtataatggctggagctgttcagtccattgggattgacaaagttggttcctgtgcagccaagttcttttgccctggcattcatcaggacagaaaaggcgctgacacttcctgaaacgtgttctgctaggccattggccacctcatttgcagactttaacatcaggccgtaaagggattgttccaccgtcagcttgtccccctccgtcagtcctaaagtcaccgcacctgattctaagtttgtggtggctgtctttgagaaagtcacggtatccggcaagctgcatttttccgcaacaagaagcgcagtcatgagttttgtaatgctggcaggataatatctggtctccccgttttttgaataaagaagggttccagtcgctgcatccataaggaccgccccttctgactggatctccggctgtgttattgcagaaggcagcgtcacatctccgccggaggccgctcctgtctgagggctgcccgtaacggtccctgtgccggtccccggccctgtttcactgacgccgccggaagggccgcttacattctctgtcttccctcctgcctccgggaacggctgtatcaggggcatatccccgtatgatgtaaaggctgcgaaaatgctgatactgattaccaggctccatagcctgcatgttttttttgccatatcctgtcatctcctgtgtgtttctgcgtgcaagtatcgtttctcacaacagtatagcataaaatccataattttccgattaaaattttcttacaaacttctattattaaagaaaaaagcaccgccttatccaggcggtgcgcatctgttaaaaaatttgctctctgtattccttttccagctcttccagcctgtccattgccacatttaagatttcagcatgatcaaatgcaagcttttcctgatccagcacatcaatagccggtaaaagatcaatctccgtttcctttttccacatcaagccctgacgttcataggtttcggtgatccgatagctcataaaaatatgttcctcttcattttcaatggtaagcgcataggtcgctccattttccagttccgaaagcttctttttccttatctggaaccagcaggcctctgcggcatcatcgccagccgttggaatcagttggtcttttggcactgcggccatataggatactgagatcactcttgttctgggatcacgctttacattcccccatgtgtagagctgttccaggcaaatgccttttaaccctgtctcttcctcaagctccctggctgccgcttcctccagagattcatcgggatttacaaaacctcccgggatcgcccactgtccgatgcagggatgatttttccgcttaatgagcaggacctctgtttccggctcctcctcgtccactgcaaaaatcagcatatccaccgtcaccgacgggcgttcgtaattccccggccgatactgcaaaagaaactctttttctgttaatccctcttcattccttcgttccattctgcccttcttcctaccagaatcttagaatatcacggattgaagcgcccctaaaagtcctgcactggcaagtcccataatcacccctgccaccaggacgcctcccataacggctaaaatactggatttaaaatcaatatcaagcaggctggctgccaaagtgcctgtccaggcaccggttcccggaaggggaactcccacaaataacaaaagcgcaataaacaacccctgtccagctttcgcctgcagtttttcgccgccccgtcttcccttttccaggcaccaggaaaaaaatccgccgatcaccggtttatccgctccccattcaagaacctttctcgcaaacagatagataatgggtactggaagcatgtttccgaggatggcaacgatataagactgaaaaagcggaagtcccattaccgttgaatacggaatcgctccccgaagctctataagcggaaccatggagataaagaaaacagtcatatatttttctaacatattccattcctttcgtgtataagtctgcctttatactatacacaaagattgactgtctatcaaccattttataaaaagattatattttccaaatatgtccgggacaagggtattaaggcaggttcagccatatataccatttattatagaggtaaggaggccttaagcttaatcttctctgaaatatatattaacatttgtgaaatactattgtactgtcaaaatgagtgtgatataatcctccaaagttgataaacataataccaaccaccaaaatggagaaggatgacttttatgaaaaatctgcttcacaggtacaggcatgtctggattctcacctatgcctttatctatattccatggtttatatacctggaaaaaacagtgacaaacaattaccatatcatgcatgttgccatagacgacctgattccttttaatgaatattttattattccttatcttttatggtttgtttatatcgccggcgcagttttatattttttctttacaaacgtaaaggactattacaggctgtgtaccatgctgtttacagggatgaccatcagtctggtggtctgcaccgtgttccccaacggcacggatttccgtcctgtgatcgactccggaaaaaatatctggtcagccattgtggggatcctttattccacggatacttgtaccaatgtattcccaagcatccatgtttataactccatttgtgtgcacattgcggtcatccgcagcgaacagttaaagaaataccggtttctcaagaccggctctctgctgttaatgatctccatctgtctagctactgttttcttaaaacagcattcggcatttgacggtcttggcgccctggttatggcttatgtcatgtaccactttgtatactctgattcttatgtacccagcagagaaaaggtttccgaaaaagcaatcagttaataactaatcccctgacacctctagacaggtgcaggggatttttgttttacggtcagaccgtcctctaattaaaaccgaaaaatttctgggtcatcttatagatggcaataggaaatttccttccgctctctcccgggagattaaccccctgtcccataaagccccatctgagccttaagtacagcggtaaattctgcttacggagatgctgccacagttcttttttcttctccatattttcatcactttccgatttgatggcaaggatggaggatatggtcatcatgatctccagataacgcaccatgtaacggcggagctttcgctgcttgatttttgtcacatcgtaataacccagcatcagctttgtcaccatgatctgctggtcaatgcggccgatcatgatcgcttcattgactgactggtcttctcttccgataaagtacctgtaaaaattcacatttaaatagtagatattctttacgtgaggcagtggctggtatacaaaaatattatccacataaaaggtatgcttgggaagttccaggccgcactgctttaaaagctctgtccggtaaatcaccgaatgcatgagaatgtaatgccccagcagaaacaccttcacatccttccaggtaaacagctcattctccggaagggcggtacggtaattcatgactttttttcgatttgccccctgcttttcatagacaaaattgctcaccagcatatccagggtctcttccccatatacaaagtgccgcagggtgtccaggatttccatataagcggattcatccacccagtcatcgctgtccaccactttaaaataaattccggtagcatttcttaatcccgcattgaccgcctctccgtggccgccattttcctgatggattgcccggcagatttccggatagtttctttcatattcatccgcaatttctgccgtacggtcctttgtggatccgtcatccacaatgagaatctctacttcctctcctcccggcagcagggaatcaatgcaatgcctcatataggcttcagaattatagcatggaattgctacagataaaagtttcacacaatatcctcctttaagttgtttttccgataaatccggatcgcacaaataacagacactgccgcagatgcggctgccaaaaccggccttcggtctgtatgaaacaaagaattcaaacgtcctgtattcatcacgaagagcgacagtaagttggctgatacgtgaaataggtaaggagccggcaaggtccctgaaacctcatacagccaggcaagagccaggccgatgaaaaaagcataaactccctgaggaagatttccatggtaaagcccgaacagagccgctgacagaactgctgacagccagaaagggagtttttcccgcagcgaggcaaaccccagcccacggaaaatgacctcttccgcaaaaggaatcacaaggccggaagccagaacctgaacgggaaagggcggtgaatagagatagctctctgcctccttataggacacggacatctcagtcagccccagcgcttccaccatataattcccaagcacggacaaagccatgccgaatattaaaatataggccagacagccatgaagggaaaatcctgctgctggaatgtatccccgccgcttctggtctaaataatagaaataataaagcacgggagatgctaaaagcgcagataaagcggtggccaccagagcgcccaggtttaagtacaaaaacagggcggtcgtcactgcagtataaaaaaacatgggaaggatcagatgcaggatgatcgatatcataaacacggtgtcctttcattttctgtatcttcctaaacattataccatttgattgcaggatatctaccaaaatatttttaattctttctaaagatcattcctctcccatttctctgatacccaaaccatgaaacctgttgatttttttattgtctgataatataatatctttatactttttgatcaaactatacggaactgagaggtaatgagatggcaaaaaaacgtattgtcctggctttgggacatcatgctttgggaacaaatcttccggaacagaaaaaagcggttgctgaaacagccaaggtcatcgcagattttattgaagccggctggcaagtggctgtcacccacagcaatgccccgcaggtgggcatgattcatacagctatgaatgaattcgggaaactccatgacggttatacttctgcgcccatgtccgtatgttctgccatgagtcagggctacattggatatgatttacaaaacggcatccgggcggagctggtaaaacgcggcatctataaatcagctgccaccattttgactcagatgatggtaaatccttatgacgaggctttctacactcccatgaagcctatcggtcgttttatgtctgcagaagacgcaaaagaggaagaggaaaaaggaaattatgtggaggaagtgcctgggatgggctttcgcagagtagtggcttctccaaagcccgtttctattgtggaaatcgacatcatcaaggcagttatggatgcggaccagatcgtcattgcctgcggcggcggcggcataccggttatggaacagggataccgcttaaaaggcgccagcgcagtcattgaaaaggaccgggcagccggacttctggcaaaggaaattgacgctgatgtgcttttgatccttacaaacgtggacaatgtcaccttaaattacggaacccttaaggaacgccccatcagccagatgaacttagaagaagcagaagcttctattaaagaagggcagtttgaaaccggctccatgcttcccaaaattgaagcttccgtggattttatccgccacggcaggaaccggaaggctatcattacctcccttgaaaatgctaaagccagcctggaaggaaaagcgggcactattataaaagaaatataaaacaattgggcaggaaactgcggcaacctttttgaatatggacagagggcagcttcatatattgaaacaaacgtaatataacggagctttatatatgaaacttttgcaaaaattaaagattgcagaaagaatcagaaagctttcggtttcttccgaaacaggaaaaaaggcggtcatggtattcctgctctttctctgcgcttttttggccggccatcttggagccatgctggtagaacatcacaaagcggtggaaactgcggcagatggaaactgggggttaagcttccagcaggaagggcagccgccggtggccaatgccaccatggactatttaaaaaagttcgatgcctattatgccgaaaagaccccggataaaatcctttatctgacctttgatgccggatatgaaaatggaaatactgcagccatactggatgcattaaagaaacacaatgctcccgctaccttttttgtggtaggaaattacatagaaacgtctccggagcttgtaaagcgaatggtggaggaaggccataccgtaggcaaccacacctatcatcatccggacatgtccaagatttcttcaaaggaagcgtttgaaaaagaacttaaagatctggaaggcctttttgaaaagactacgggacagcccatgaaaaaatactaccgccctcctcagggaaaatacagtgagtccaatttacagatggcaaaggatatgggttacaaaacctttttctggagccttgcctatgttgactggtatcaggataagcagcccacaaaggaagaagcctttaaaaagcttttgggcaggattcatcccggcgccattgtactcttacacagcacctccagcacaaacggccagatccttgatgaattgctgaccaaatgggaggaaatgggctatcagtttaaatccttggatcagctggtggctgagtagcgggctgcttctcgtcccgtcagaaaagcaggaggtgatgcacagcaaaatgcaacaactgcctgatatggtaaaatagtttatgacataaaaatgagtcctgacatggttttaaaccgtttcaagactcatttttatattctgttttacggtaaaacgattctgcaacagccctcctctgccttacagtcataaaaggggctttctgtcactccaggaaaatatcctccagctgtctgatgacggtgtcctccagccataaggcctttctggcatactctctgacagagccgtaatcctcaagaattttattgatggaagcttcgatatactccggttttgtgtcaaagagggagaagaggtaatcggccacccgtttatccttagccagctccagatatttttggtaatagcggacatttttttccgctcttgcccttttggtgagcatataatcatagatcatagtctctttcgggacacccaggatcccttccaaaagcatggccccgaatccggtcctgtcttttcctcccctgcaatgctgtacgctgggattgtttgacttctgtgccagaagccttaagctggttccaaaggccttccggctttcatcgcatatgacaaagttcagctgctgctgtatcatcctcaaatcccctgcattgggattttcctctaccgccagcctggcctgctttatgacggcttcttcctttgcaatgttttcgttattgtgaagaaggcctgccatcatggccgtatgagcgttgggatcgcaggaataggtggtcacgccctctcctaagtcccggttagggctttttataatctccatgtcgtttctgtaatcaataatggttttaattcccaggctttttacatactccagtccgtcatcttccagaaaggcgaaataatcggagcggaatcctacgccccatttcattcttcttcctgatccggtcatatatcctcccatatcccgcaggttatacattccatccactggaagaatcctgtatccaaacaccatgggggcctggtttttccattcaatgataaaataaatctgttttcttttttcaggcgcggcatggaaaatcaaccttttttctctggatgagaggagaaaactacggttcttggtaaaggggtccttttcataggtccagtacagctgatattcttccagagcctctgcatccgaaacaatgtttaattctgttttgccgttatccagaggaaaggcctcgacgtattttatctccatggcactacctcttaagctgttctattttctttttcatatccacaggggcgtcataggcagcgacctgatactcgattttgacgcccatttccagaagcttatgaaagtcttcctcttcctttggggaaaagcagataatgtggtcataggatatggttctctccggagtcgtcctcatccctccgaagttaatgtggtcaatgggcacgcccccttctttcagccttaaagcgtcgctgaagcttcccatgatcataaatgtgttcttcttaatgggattatttgcatataccctgataaacttatccacgccgaatacgtggaccgtataggcaggtgccgccattttcagtacttgaacctgtactggattttccactgcagcatcactgatgcagatcacctgttccgccccgatgtgacttaaccaggaagttgctacctgaccgtgaatcaaccggtcatcaatacgaatccatttgatcgccatcttgttcccctcttctttcagcttgtcgttaatgcagaccagacccattttataggccctttcaatgatcgtgccggcttcctccagtgtctcgggccgggctataaacagctccatgagcaccggcatgctaaacccggagtacaccagaatgtcaggctccgtcagggctaaataggtggccgccttggccggagtccctccataaatatccgttaagatcaaaactcctgatcccttgtcttcataggaggcatgtaaatccaacagctccttcagacactggtcatagcttttgtccgcggtcacggaaataatatcaacgtagtttgcaatatccccgataatcagtccggccgtatttaatgcctcccgggcatataaaccatggcttgcaagaatcatgcgaattcccatatctatcttctctcccctgttttttatttctgcaggcaattctgactaaaccagaataccggccattgccagcaaggttcccacgatcaatatgccgaaaataagcaggattaaatattttctcggcatccggccgtgaagcttgtaaagcccgatggtgaacaaaagcggaagcagcttcggtaatatcccgtctaaaagagcctgaatatttacaacggtctcattgatgacaatttccgtgcccacgttgatcttcacgtaatttcctatgagggcgcccagcacgatcacgcccaccatggtggaaatatttatgattttctggatcacctttgcctgctccccgctctgtacaaattcgatccctttttcatatcccatcacagtaccgaaatacttgaccccaatgttgatgccgttataaatcaggaacatcaggatggggccgatcaaatttccctgcagggcataagccgcgccgatactgcctgcaatggcctggatggtgatcttaaatacgctgtcaccgattccggccaaaggccccatcatgcccgcttttaccgcaactacggcatctttttcgtccaattccgtagtttcctcaatggcagcggtgatcccaaggatcatgccggtggccgtgttttgagaaaggaaataggtcaaatgcctctgcatggcctctacccgggcagcttttccagcatccttataaaccttttttaacaccggcgccaatgcggtaataaatccgatggcctgggcattgcttgaggtcacagtgatcccaaggccgaaaatctgcagacgccagtagaccgcatttaaatccttgcgggttatttttatgtaactcccttttgcctttgtattgggattatccaatccggccgcattttctttcccagcactcataagtcataccctccatcctcgtcatctccgcggtttgaaacgatcacaggcacctcattctgacggtccttaatctccatcataacggaatacagcattgcaaatgccagagaaatcagggtcaccggcaaaattcccagtcccaggtaagtggacagcacaaaaccgaaaatcaggaaaggccacataaagcccttcatcatcattgtcatcaggatggacaaaccaattgccggcaatattcctgaggcagtgcttaagccctttaaaatattgctgggaatgacatttaaaatcttatccaccaccccggttgaaaaatagaccaccaggaaggtaggaaccgcacggagaagaaactggaatgcgatggcaacataatttaccagtaatatgctgtcaaaatctccggtcagcgccagcctgtctgcccatactgcgaagaactgacggacaaagtcaaagatcagaagcagctgctgggataaaaccgccaccgtcgtagccgctgccacgcctgctgcgatcccctctgccgtagctcctgtgctggtaatggaaatggtcgttcccacgatggttccgataatcatgtccggcgttttgtaaccggccatgtttccaagccccatccacatcagctccagggtcgcggaaatgaccagtcctgtcttaacatctcccaatatgattcccaccagcggacctaccagcaaaggccttcggagcatttgcgggccctgatcgtcaaatgaacaatacccggcccataccgctataagtagtgcctgccaaactgccataattgtatacccctttatttgatacaaaaaaaatatcacaaatccgccattgcctcaacgtctactttcatcactgaacgcgcataaatttagcaggaaaaatttgcgccttattgcgcaaaaaaatagggaaaggctgacctgtaacaggatcagccatcaatatagtgccgaagctcagaatctccgttcttgacctccaccagccctttccttaagtccagcaggatgaaatgaatctcttttacggctgcaccgtttaacaggatctcctgtggaagacagaagatataatactgctgctgcggcccggttccagtaaaaatattgatatattttttcttttcctcagccacataatccgtatggtaaatgacactgtgcattaatttgtaaaaccccagctttgtatagccgggagcgatgttttgacgccagaaaaattctgcaatggtttccgccaggttttcctgcccgcagtctaactgtatcaaatcaggggatcccatgtaatttaagatggcccccctttctcttctttgcaatcaccttggcccaaaggtcataggaaaccttgctgaaaaaatcgtaataataaatggggatcgggaaataatccggcttgaatttcatgcctcccggcaaaaagacgtaatcatactttgaataatccagtcccctggcttcgtagaaataatgggaatgaaaatgaatattcaattcatccacatttaaccccagccgtcttatgaccgttggatcagccgacttcccgatttcattgatcaggatgacattggtgggctcatactggttcctgatccggtaaacaagattatagatcagaatgatcagctcgtaatacatcatgtcctgtatctcatcggttctgtatcccggaagctcattgtagatataatttgccagggcctgagaggaaatcatccggttggccctgcattttatggaatagggatattccagctccacaatgcccacctgattcctcagctgccatttataaaagaacaggagaagggaatcactgacctcttcataaggggttaagtccaggaatatattttcttttaaaactttcatgacctttttataagtttccaccgcctccggcactgctttctcaaagctttcacctgccccgtcttcaaacaattcccggttgcctaatagaaaaaccgccatgtaatagtactcctcaagctctcttccctttcccaggattttttgccccacagaaaattctttcagatcttcaagatcagggcggaagtcctggatcatcttctgtccgcagcctgttcttaagggtaaaattgacagataaaggaccagcctgtgaaaccctgtatcaggaatccggtacccggtttcatctaaaacctgtttcagccttgcagcattctgtctgatgtcctccatggcaattccgtattcctttaaacagtggaaaacaaagatattctgttccgagttattgcaaatatcacaaaaatctatcaggcaggaacggatggcaagctcttctcccaccaccttcatcccgtgataagggatggaaacgatctgtatctgatacagaagcaggtactttcttacggctctcatatccttattcagagtggcaatgctgatattaagcatgtcagccagttcttccgcctttatgccgtttatggaggccgcaaggcggcggatgatgtgctgcaccctttcctttcgtcccagaagccggtttaaggaaagatttaaatagccgtaacaggagcgtctcagctcatcgacccagagcccagcctcaggaggatactccagaaaatatccctttcctctcttgttgcgtattctgacatttgatctgccattttgtttcagcttgtcattcagggatgcaatttctatttgtaccgtgcgcagggaaatgtcgaacatttccatgatcttctcattttccacataactgttttccaaaagcatatttaaaacactgatttctttgaaattacaatcaagcataaacccaccttagaggatgacctttgtgtttgcgtcaaaacctttccttcctgtatttctttttttgccggcactttctatgtactctgactgccccataaaataaacagggcagtttttgagtttatcgtatattgttaagcgatgaaacccaaacaattactttaaccaaaacctgcctgaatataattctatcatccattccgggaactaacaattattacttatttttttacttaatgatctcgtttcccggcgaatgttaagagcaaaaaaataagccagatttccttttttaaggtgagtatccggctcattctgctttattctatttttaatctaccggaatcaccaaatccttgtattggtcaatggtattttcaccggtccatttctccgcaattttccctaaggttccatcagcaaacatagactttaacgcctcgtcaaatttttctatgaattcatcagacaccgactggttaaatacctgatatacatcctctacgataaccggttcatcagaaagagtaagattttccagatttaagtccttttgcaccgtatcgtaagagcttttatagatcaaaagtacatttctttgattggtggcaatctgctgcaggctgtcagccgtagtgatgtcgcccgatgtatccacaatattaatttcctttcctgggttggctgcattgtatgtatttatgatttctttctcgtaggaggtggaagcaaattccagtgtctcgccggcgatgtctgccagtttctgtagattgtcctcttttctgcccaccaaatacatggggcttaaagcgtaatactgagcaggaaatttataggtttcttttcgggtggcacttgccacatattgacctgagccgaagtcaatgcttcccgcctgcaacgctgcaaacagagctggggatgcgtcaaatcccacaatttccacttcataaccgtcaatgcggttaaatgcctctgtgaccacgtcttcctccaatccgatcagattccctttatcgtctgtgtaggaaaaaggaaggtgagcctgttttaccccgcagcgaagtacgataggttccgcgttcccttccgcttccgtttttacttctgctgcttcgctttttgcttctgtttgggctgctgtatttgtatctgcctgctttgccgtactgcagccgtttaccccaaggactgcagccaacactgtaataattaatgcactttgttttcttttcataatctttctccttttcatattttactttttataacactttgtcaataatgattgtacatatcctccataagagaaatacacccccggataccgacatgggatttgtttaaaatctctttatccaggcagggggcggaaacagtcacaaagaacgagtccagtttctttgcaatattcttttcataggtgctcccgagaagaagtgtggcccgtccctgatacttttccgttatctgctccactaagtacacgtcattttcaaagtatacatctgcctttctgtcgcaagccaaagctttgatatgggcttcaatttccggttgaactttatcgggtacactatccgtacagatcaccgccaacggaatgtgcccatgatcgttcgtcaaaaatctggagattccaagcacaaaattgctctcacccaccaaaatatatctgtggcgttcaaaattgcccataagagaatcaaagtattcatacacatactgttgttctacaaaaatcacttgatcagccaaagctttctcaatattcaattgctccgcgatctgacggatcaagtctgccacagcagtggggccgatgggcatcccaggataattcagagtggggatgccaaaagttttttcataataggcatccaggtttttattaagccaggtggaaatattaatatttaaagccgcatttcctgaatcggttatctgctgtatcccgtctctggcaataaaaaaagtattcacctttaatcccagtttttgaaagatacgggaaagctcctctaaatcaccacggaaggtcatatcttcacttggaacctgaccatagagattgaccagcttcggatcagtctctgtttttcgggccagctttttcactactgcaagaagtgtactttgatatccatagtaagtatctcctttaaacccagccacatcaactgaaatgatgggataagggctgtcctcgaactctcgcaccaccgcctccacatcatctccgttgattcccatgctgcagccagtaaggacagcataaagctcaccgtccattacctctaagcttccggctatggtctctctaagcctacccgcaccaccgaataccacttccttttcgtaggcgttagaactgggcatcccgtgatagcctcctaaataatataggtttgtttgaactgccgcctgcatactgcatccaggactggcgtgtaaaatagggattcctttatataaatttcccactacgtctatggcaccgtttaaagaacaaagaatccttggacgctccgtgcactttttcatctgacctatcctccattttttcatttactgccttgaagcattttttcagctcatagcttttattgtgccggaaaatcaaagtatttaaaggcatcctctttataccaactgtccctaaaaggaggatttgaaaaatcctttaactttttattgaaattattattgtccaaagcatcctcgattttccgccccagatacaaaacgcccctgtatccaaaggtcggccgttttccatctaaaatatgggtagtgggaatccccagtctggatacccagtttgccatgccgataaatacatccggtttcaattttttaattaaattgatctgctcatatggctgcatatctgctacattaatgaggaattcacttccgtggtattcctccagacgctcaaaatcttccacatacgctttttcataataaggtgcatggatacacaaaagctgcatcccatattctcccattaaggtggcggcagctaaaccgcgcccggtacctgccgtaatacagaccttaagccccttcgtctttttcctgatatggccgatttcctcttctacctcgccccgttctctctctataaattcctccgcctctttttcttttcccaccagtttggcaatggctcttaaccaccggtctgtgctgtctgaaccgataggcatacaagtgacggtatagggagttccatattccttatgtaaaaagtccatatactcatcccaaagatctgacacacagaaatgttatactctgccgccggaattcgcatgatgtcctcataggcagcattgtaaggcataatattggcttccagaccaatggccctaagcatgcgcttcatctccagctgatccgccaggcttaaagaatgggtggcaaataaattaatgaggcctttctccttttggggtctggcattcctgatgacaaaattttgcagggcgcttaaagccagatcatatccggtcgcatggtttctggatttaaagccttcacagtgaatgggggcaaaaatcacatccggatattcttcctgcaatcgttctgaaacagcatcgatatcgtctccgataatcgcagatgcacaagaagacaaaataaaaatcattttgggatggtgccttaaaattgcttctcttgccgtttcctccagacggccctcaccgcctaatatcacttccttttcccctaaagcagtggatatgatcctgctgttttctccattggtatcgcccatatgatgcttgtatatattgattctttcgatggctgccagactgccgcaggcggaacacccataggggaatgtataatcataacagaatcctgaatactggccagcgcattcacgctgtttacctgaacacattggattccctgttcaaatttcctgtgggcatttttcaaacaatttttcttaactctgtcacgcatatgtcctgcacttcctgcctgtgcgtcggtaaatccctcccgcgtatcacggatcttatccctgatgattctttccattttaccagatcccctttcctgacttttagatataataaatactgtcctgcgaattaatgcgggttaaaaactgtttggttctttcatttttaggcttgccgaaaatttcctttggcgtccccgtttctactaccaatccctcatccataaagattacctgactggcaacttcctgggcaaatgacatttcatgagttaccacgatcatggtaatacctgtctgggccaccttttttatgagttctaaagtctctcccactaattccggatctaaagccgaggtaggttcatcaaataagatcaccttcggagagagagccactgctctggcaatccccacccgctgctgctgtccgccggataagttgacaggataataatccatgcggtcagacaggccaacccattccaaagtctccacagcgatttttttcgcctcttcttttgactttttctgaaccgccaccagcccctccataacgttttccaaagcggttttatttagaaataaaccgtaattttgaaatacaaaggcacattttcttcgaatatttaacgtttcttttttgctgctttttttcatattcacggtcagatcatcgatcgtcagttttccttcatccgctttttccaaaaaattgatacagcgtaaaagtgtggtttttcccgagccgctgggtccaatgataaccgttacatcacctttcttcacccgaatggaaattccttttaaaatttgggagtttccaaagcttttctttacattttccatttcaatcataatgtcactcccttctcctataggacaattccctttttatatttgctcatcttctgctcaaacctacgaaacagttttgaaaagacaaagcttaatgtttcataaatcaccgcaatcagaaaaaatgcttccagaaattgataactgggactggccagggtataagccatgcccgtaatttccaccacgcccgaataataagccagtgtggagttttttataaggccgataaataatcctcccatattaggcagggcgataacaaacgcctgcggaaagataatgcggaaacaggcctgtaaggtggtcattcctatgcttttcgctgactctaactgatcgtggggaatcgcaagcagactggaacgaaaggtttctgaggcaaaagcagcctctgaaatgctcatagctatgatagggtaaatgatgcttttatttcccgccacagaggctacggaaagcccgtgctcaaaacgataataagcgataaacgtgggtatggcataataaataaaaaacatgataattaccaggggcacacttctcataaaagatacataaacagcaaacagccgggacaggccttttattttatttatccgaattaacgcgattacaataccaaaaatccagccaaagaaggcggagaaaaaggtgataataagcgtattttttactgcaggtatcattgcaggcagcattgatgcgataaattcaaaatccatgaatctcctcctctttaattcatctgtatttttttgcctttggtatacactcgttccgcccattttgtgatctgttctaaaaagacactcaccacccagaatataatggatacccccaaataaagctcggcacggttcaatccatataaattagaactgatcagctttgctctgccgaacatatccacggctccgatggaaaaggccagcgacgtagacttgaaaatataaataatgttattccctaaaaccggtatggcgaccccaaaggcctgggggaaaataacccggcgaaaggcagtcaaattccccattcccacgctataggctgcctcccattgatacttatcaaccgacagataagcagatcgcatcatctctgccatattggccgccgaagtaagagacagtgttgcaataataaaagaatccttgttccaggatgccgtattgattccgatcttttttaaatacaggggcatgacaaaatacaaaataaaaataagcaccaggattggcatccccctcataaaagcaatataaccctttgccatggcgtttaataatttactttttgctaaagccatgcaggcaaatacaaagccgatgagcagtccaaagagcaaggaaaacaaaaccagctttatcgtgaccggaaaagcggtcatcacctttgccatgagccccggtattttcataaagttaaaatattgattcatattaactcacattcctttcgccttggttttctatctgtgccgtttttttattttataaagacagccatatgaggacccccacggttccgctggctgctaccgcaccgcttgagagccttcccagccagaacatgccggcaaagttataggtcatctggatgagctgcacgcccatggtaggaagggaaaggcgcagaagcccgggcattattttgccggcggtaagatcatattttgaagctctgtcagacatgaatccctcctttggctcaatattcccagttgacgaatctgttttttaacagattcaccacctcgtttaatcctgtgaccacgatcccgataaatatgatccctgcaatcgccttggtataatttgcgtaatttaacgacacccggacataaaatcccattccgctgtcagcgccgatcatctccgccgccgtcagagtcatcagggcggttgacagatggatgggcagaccgttgatgatccgcggcatattgaacggaataatgatcttaaagagtatggtaaatgtagatacgttcagtaccttggcggaatttatgatccggttttccacaaaagcggtattattgatcatgcccataaaggttccccagaagatgctcaagaagatcacaaacaatgaggccgccttaaaggtgggcatcaaaagcaccacatagggcgtatagatcagggccggcacggttgaaatcgctttagtaatcggatagatggcattccgcagcctggggacccagcccaccagggttcccaggatcactgccgaaacaatggcagagagcaggccgatgaccagcagatacatggagctggcgaagccttccagcattacctttgcatcatccaaaaacacataaaaaacattttccggcgccggtatgaacacatagggcagaaggttcagcctggaaaccagcagctcccacaccagaaaaacagcgtatacgaagccggtaatatcctttgtcgcctgcattttcgccttattatttatttttataagataaatgatctctaaaagcacaagcaccgcaccgaatgcgtaccagtcccttaatccgatcttcatttcggcagcgtaacggcttggcagaaggaaacacagccatatgaaaacatacagaaggttgggaaggttcaggattttttttgcggtcataggattacctcgcttcccccgatttcttttgatacatgctccatatagaacaaacgcaccagttccccatggagtctccggtattcatcattgtcgaacagcacctctttgctgcgggggcggggaatggaaacctccagaacgctatgtatccctttgggcaccatgaaaacaatccggtccgccagaagcagtgcctcatccagatcatgggtcacaaaaacaatggtttttttactttcatcctccacccacagcttcagcagcagcagctgaaggttttcccgggtcttggcatcgattgcgccgaagggttcatccatgagcagtatttccggcttacatgccagtgcccttgctatggcgactctctgctgcatccctccggaaagagcccccggcagtttgtcttcgaatccatgtaaatctaccttgtgcaggaattcctctgcgattgccaaagaatcttttttgcttatttcatttgttttctttctggattcccttacggcaaatgccacattctgccgtgccgtcatccagggaaacagggaataattctgaaataccaccgcccgctccggcccggttccatgaactgcttttccattgatcagaacttcacctgacgttgcctgattcaaaccctccataacacttaacagtgtgcttttaccacatccgctgggaccgatcagacatacaaattcccctttttggatcgataagtttatatgttccagagcctgaaatgttgttttctccgtttcatacgttagactcaaatcgcgaacttcaattaccgcatctgccatatcctttttcccatactcccttctgctcagcttaaaccgcttgaaagccggtcttttccggggatcatctcccctttgtgtcacaggtcatcacaggtaattaccgtaaaccttatcaaaatcaggatattcactgttatttttttcaaaatatttccacatatccgtaaagaacgtatcatccgggtattcttctatcacagcctttaaggcatctgcatatacggacagatcataaaactgggaaagtacggttcccttttccacataatcccattccagaagggtgtcataaaccgccagcgttccattataattggggtccgggttataggtacggtttccgttggtttccttgttgtaaatataatttttaatatagtcttccgtttcaccggtcgcctgtgcaagggatgccaccgtcccggcttcatcctttacgtagtctttatatgcacggatctgtccttttaaataagccacatatgcctccctgttgtctttgaaggatttgctgtatgcggtctggcggcagcatacgtaatcctccagcagattggtcagcggaaagaggtaaaccaggccttccgaaaccgcgccttccacatactccgcggaaataaaaccgatgtccaccgtgcctttgttgactgcaagggaaatgttgggatatccgtcaatcagcgtatacgttaaatcttctccggctttatagccatagtccttgcccagtacatacttggtaaccatttcggatgtggacagctggataacgcctatgtttttgcctttccagttttttaaatcctttaattcttcttcgttctcaggccttacaacgacgcacattccgcctgaaatagtgcctgcaaacaacgtgacatccgagccctgggacccgtagctcaagggcgggatcaactgtccgtaggtcgtatcaacctttccgatgctgagggcttcaaaggtgcccgaggtttcaagggtggtgtttttgagttccaaacggtagccgtcaaaatagcccttctcctctgccagctggatcagcggattcgtcagcgcggaagaactggtctttgccacgttgagcgtataacttttttcacctgtctttgccggatcccctccggcctcctttgattttgtgcatccggaaacgcttcccgttaccagtattgcggccgtcaatgcccaaaacagcttatgatttcctgatttcatttaactctcctcctgtctttttctttcctgtgtgaatgattccagcacccggatcacttttttgttttcttcaaaggttccgacggatacccggatccagccgtcaaggccgaattccgatgcatttcttataataatttcattttgcagaaaagccttctccacggcttctccgtctgctccggtcctgatcagaataaaatttccgtttgacctcacataatcaagtcccagccgttttaattccgaataatacagatccaggctctttctgttattgtcaagcacaagtcttttaaaatcctcatcctccagactcacttcagccgccttttgcgccggaaagcttacgctgagagggcttcttaccttatttattttttctatcagctccgggtctccgattccgtatccgatccggaaggaggccaggccgtagagcttggaaaacgtccgcagaaggatcacattcttatgctgttttatgagttctgtggtgtcaaaataaggttcttccacaaaatcgatgtatgcttcatccagaaccaccagaatgtgatccggcaccttttttataaaatccctcaactgttcttcctttaagaccgttccggtggggttattgggattgcagatccatatgatttttgtctgcccgctgatcaggcgcaggatttcatccgtatcaatggcaaactcctttaagggaatcataacaggcttcccgttcatctgcagcgtcacattccggtaccagccaaaggaaggatccggaatgactgcttcttcccctgtttccagatacgcatgggcaatcaatgcgatcagttcaaaggacccgttgccgaacaccagatgatccggttccacgttatggatagaactcagccgttctcttaagaccgtgcagttagaatccggataaaaggagaactggcttttctgttcttccagaataccggctacccgggaagagcagcccagacggttttcatttcccgcgagcttgatgatctggtccaggccaaattcccgtttcactgactctaaggatctggccgcctgataaggcgcgattttctgcaccccgcttctttctttaaccattgacatattccaattcctttctatatcttctgacgtagtgatccgcctgatatgccgcgtttataatcgccctttcctcggagtttccctccaatatggaaatccctccgaatacctcccggatccggtctgaaatgacttgaagcttctcctcggtctgtccgtctatcccgatctcctccagggtgaaggccacttcaagctcaccgaacttctttaccacggcaaggatttcctccccgctcttcttttccagaaccgcctgcatgagaagcccgaatgccaccagttcgccgtgaagcgtctttctggtttccttcacgatcctggaagaatggtaaaagggatgggcaaatccggaaaatgccttgtctcccacatagcttcccacatttcctgccaggtaaagaatggcatccaccgttttaacggtattttcatcaatcttcttttcccttgcattttgtatcacctttgccgcctgtttatccagaaaatcatatgccagacgtgcggtattgacagaacttatatgggaaaagtcgctgtccgagaggtcaaaacccacggaagtttcataccattttgccagggtatccacgattccggcccttaagtaccgaaccggcgcatttgccaggatttccgtatccgctaccaccgcttttggggaatgcccgttgcgccggaaatgatcaaagtttccttctttcgtatacatcacggacaatgcagcccaggccgcgcaggtggcggctatggttggaacggatataaccggtatttttaaaatgtctccggctgcctttgttgtgtcaatgacccttccgccgccgatcccgatcaggatttcgattcccttttcttctgacagctccgctatttcatttgccttatcctccgtaggatatccctccagcagatattccatatagatgatcctctgtactcccagagcctcggccacggcttcttccgtgacctttcttgccgttgccgaccagacgatcagcccgcgctttccgtacttttcagcaacggtcccaagtgattttatggcgcctggttcacttatataaatttccggggtctttacctgtaacatttcattctcctctcctgctaaacaatgcttttcttttcatacttccagcatgcgatttcataggaaccgatccgcaagacgggtggttcccgggttttgcacagctccgtacattccgggaatggacttcagcagtcccacggtataggggtgcagcggattcagaaacaattgagggcctgaggagacagacatggctatcatcactctttgcctcattcccccgctcagctggtggggataatccttcattctttcctttgccgccggaatcccaaccaggtctaaaagctccgcttaagcttcctttatctttattttcccaggccccacccttatatgaaataattgggttccagagaaatgatcctggacagaaactgtctggttctctcttccctgggatttgaaaaaatcttttccggcttcccttcttccaccacaactccgtcgtccataaaaatcaccttatccgccacatcctgggcaaaggacatttcatgggtcaccacgatcatggtaattcctctgcctgccactttttttatgatatccagtgtttctcccaccagctccggatccagggctgaggtgggttcgtcaaacagaatcacttccggatttaagacaaaggctctggcaatgcccacccgctgctgctgcccgccggaaagctgggaagggtagaaatgatatttctcccctaatcccacccagtccagggcttccttcccctgcttcatggcttcctccctgggaatacgccttgccgtaacaaggccctctatgacattttccaatgccgttttattggcaaaaagattgtaattctgaaacacaaaggccgttttccttctgatctccaggatctgctttttagtggctttttttaagtccacacaagtatccccaatggcaagctgtccgctgtccgcattttccaggaaattaatgcaccgcagcaatgtggtttttcctgatccgctggggccaaggacaaccactacctggccatcctccacctccacagaaacatcctttaggacctgctgctttccaaaggctttttttacatttttcacttcaatcatatggattcctcctaaatttactcatatggcgtcttaaagcccttgccaggtattcgatcacaatggtaaatgcccagtatatgactgcggcagcaacatatccttcaaaaaaagaataggtccgggagctaggaatggtggctcctgccacaatttcaataatgccgatggccatgacaacagaggaggccttgatcaaaccaaccacgtgattgatcagggtggggatggctgccgggatcatctgggggatgatgatccgcctgatggtctggacctttgtaagtcctacggaatacccggcttcatcctggcccttgtcaatggataacagagctccccggatgccctctgaaatggaacagaccgcagtaaggctcagagcaaaaattcctacccagatattatccacgtcagcggcttttgttttaatatgtaaaaatctggccaggtcattgaatttgagcatgaaaaccaggttgtatatcatcagtgccaccacaatgggaacgccctgatatacggtaacaaaaatcccaagaagcttatgtaggacaggtactttgtagaccctgaccagcgcggtcaccgttcccagggtcaggcctattgccagtggaatgaacacaagcctcagggtgttgggaaaatacctgataccataaataaagctttcataaaaatgagcggtattaaaattcattctaatccttctctcccatactccagttttgtattcaggtaataaaaaagaagccggatcgttaaactgataacaatataaattatcaccacaaacacataggcttccaatacatgttttgtggccgcgccaatggatttggccctccccatgatatcggtaacgccaatgagaaatacaagggaggagttttggaacagccccaccagatcagaaccaaagggcggaagggcgatccttaccatctggggcaaaaggatccttcgaaaggtctgaagctctgtaagccccacgcttaaccccgcctctgtctgcccataagggacagaggtgatcgcgccgtaaaatatggctgaaagaaatgctccctgatttaagataaatgtgatataagcaaaggtcaccgcactccagccccggttgatattggtacctaaaactggatcaatcagagccggtatcccgtaataaatgagcatcagctgcaccagcatgggcgtccctctcataaacgagacatacaccttaaaaaacggatacaggaccggaatccttttaagctctgtcagaacaatgaaaaccgcaagaagcactccgaatacagtggcatagatcacgatcagaaaggtcactgataaatatggaagaattttagggatattttcaaagaaccgctcccagccaaacagtttatccataccattactcgctttccgtataatccccgccgattacatcctttgatatctgtgcaagctttctgctttcttttaactgcttcaccgcttcatccactgcctcctgcagctgggtattgtcctttgcaaaaatgaaatacgtggatgaggactggatgggctcccccgtcacctttatgacttccttgccgtttccgtagtttttattcagcttttccgtatcccgctttgttaagatggtggcatcccatactccgtttaaaagaccggtaacagtctcttcatcggttgaattgttcacgtagtcaatttttatgggattatcttcatgatccttattataattttccaggatgtacacggaatttgacccggtagagctttttaccttccgtcccttaagatcatcaagagactggatatctgtcctgtcatttgctacggccagataggttacataggtggtataaggttcttttccaaacagatacttttcatctctttcctcattccattcatactgatgagctgcaatatcaatcttacctgcatcaagagaaatcagcacattggcaaaatcagaggtctgataatcaaattcatactgagggagcagctcatccactgcttttaaaacctggtattcatacccggcaagctctcccttttcatctaagtagcaatatggttcataggcgttgccggtcccaaccaccacttttgtgatgccgctgtccgctgctgccgcctttttcccgcagccggacagcactgccgcccccaatgctgtcaatactgctgccagagcaaacttctttatccctcttctcatcacttttttccatcctttctatttgacgtttcatttgccatcccgcgaagtgtctgatggtggtccacccggtgaaaataccaggtgattttctccaatgtgtcctcgattttcccttccacatcaaaggcgctgaccgcctttttttcaagctgcttttgaatgtggaagccgatctttttacagatgacacaacggcagtctgctatggaatccacccagggatggctctctttagaactctggcagcccccgcctttacacccgtcattacagaaagaaggctccccggcttcttttacggcttccctgatttccaaaagagcgtactcaccgctttcccccacctcatagatgagaaatttatgggctgccccaaaattcacatcaatgttcactccgtcagaagatgcaaccgcaattttatatggcataatatttcctccatgaaacggatctgttaattgaatcttgttctggcaacagaataaatgtcctcgatcagctttaagcccccgtcatatcctgcataatagctgttcatcaccaatctttcgttcaccggccaggatacattaaggaaatgggcatcggtctgctttgcgatctctttctcccaatggcctccaagaatcaggggatatccatgatagtcatgggctttgatctcgttgtggatcttgtagccatctgtctcaaaactcacctctgcttctatgccaaaattcagttccttaaaataggaaaagaccttttccctgaattctcttggggtgtcatccgtcacgaactgctttgcgggaaataaacccagatcattgaccaggaacttcgtaatgccaagggcatattgggcgtcggatacaaccgtaaactgttttgacatgactctggtctccaggaataaatccgcatagcgttcgatgtagtagtaataataagcttctttctctgcaatcaggctttcaatcttctcctctggcactcttgcaaacccgcccacttcccgaaggaatttactggtttcaaaggcccctatggggagcgtcggatagtggaggtaaggaattccaagcttcttctccatgttcttcatattattaagcccgacccaaggagacaccagcaggttaaattcggcttgcggtatcctctttatgttacttaatcccctttgatagccaaatatcgtattcggcgtaagaccaagctcctcaaccagtttttcaagctctcttaaatttcccagccagaactcatcctgataaggcacatctgcccatatattcaccagattttttacccggatatctgaccgctccaaaagctggtcaatgattgcatccaccacctgctcgtggcccttgtagttgttgcccttaaatcctgcggtggaggcatagatcaccggttttttggcatcctgaaacccttccaccacttcttcggtgttgtcacccacgatctccgggatacagccggttaataccacatataaatctgcatcaatgacatccagggaatgcttgatggttgactcaagctttttaacacctccgaatacaacatccctttcgttgatgctggtacagggatagatgttgggtgaaaaatagccggagcttcccgaggaattggaaagcttctgggcacaacccggaccggaatgaaggacaggaatcgcccgttcgattgcctgaacggtctgcatggcgctcatcgcgcatttatacctctgtttatctaagatcttcgccatcagccaatcgcctcctctaagaagcttcccacatcctgcttataccaccagtccgtgtaaggcagcttcactctttttgccagattctgttcaaagctccggttccgtatggtatctaaaaccgtatgagcgaactccagggtatgcttatatccgaatatcatgtattcgtccgccacatagactgccggggttccctgtttaatggcccataccgtggagccgggatggcgggaaaggtataaatcagggcggtacttatttaagatgttcattacctcaaagttctgctggtccgccacactggcttcaaaattgatattattgtcaagaagataactcatggcaggggaacatccccgttttcatatttcttgtcataatgccatgccagcgcccaaaccacttcaattcccagctcgtttaacactctcgttacctcaaaggtgtagcccggtcccattccaagaaccgcttttaatccctttaattctttcttcaccgcttctatctggggaatataaatttttctctgttcttctatgtaatgttccacttgaagctgcttgccggcaactcttccgatttccctaagccatgtctcaaatccgacgatccctaagggattgacggtccggatatagggaacgccgtacagctcttctaagccgttgcccagataatttccaagaactccgcagatgcatgtcgtagcaacggactcagataaatgttccagttcttccaccgttgcattggcatataaaaaaatgggctctaaatcaaaattcttaaacatttcaatgacttcatttcttgcgctttcgaaaaagtttttaaaattaacggtgtttcttttctgctctggcggctttacgattccgcttaacaccgcatgatcggatatatcaaacccagtcgcccaaatccgtgatttaaagccctcacagtgaacagctatgacaggcaccggaatctggtccttcacatcatccaccacgctgtcaatatcctctccgatgatccccgtggcacaggagctgctgacaaaaattgcctttggctggtaacgccggttgacctccacaatgatatccgccagcgcttctgtggagccgaaaatggtatcattctcattcatatctgtaccaatatagacggatttgtttacgacacctcttttagcagccacctgattggtaatgatgtactgagaacttgccgtggccgagcacccggaagggccgtggtgaatgaccgccacatcccggatccctccaagctggctgagggcacagccggataagcaggtacttgactgggaaaaacagcgtccgcagccctttaagctgccgcatttgctctggctggcaagatcatgcaagtctccgacatatccggttatggagcctagccgggtctccctggtggccagatttgaatttgataaattaattgccatatttaacctccaaactttcactatgcttcttcaaaaagtttcgtggacaggtacctaagaccggtatccgccaaaataaccacaagattctttcctttgttttccgttctttttgccaccttggttgctgcgaaaatggcggccccggatgaggttcccactaaaatcccgtccgtccttgcaacttcctttgcagcttcatatgcctgataggtttccacctcatatttttcatcgtaaatgcttccaccagaatatccacctttccctctgtatccgcccatatctcgggccctgtggccgcttcatgaacggaaggatttgccagattttcgatctgattgacaaagaagatgtttttttcttttgacagcactttcttctttaatgttctgacagccgctacaaaatccccgcctgtttcatctaacactgcctggacctcgggcacctgggaaaatctggttgtttctccgccaaaagctttgatgtttttaaaccgctcctcactgacattatcctggacatataccctgaaggaatatcccctggctgccgcaattgccgccatgccgatccccgtatttccactggtggtctccacaatggtataccccagctttaagagtccctttttttctgcatcgtcgatcattgcaagtgcaatcctgtcttttacgctctggttgggattgaaatactcaggctttgctatgatcttcgcttccagaccgtgttttctttcataattctccagctccaaaagaggcgttcttcctatgagttcggtgattgatttatgaatattactcattgattccctccttgatccagcacctttgtgcttagatcttataatcgtcattgatattcatgagtccgaattcaaaaaggatctcctccagccgttcctggtccatgggcgtgggaatggtgaaatcctgattgtcgatgattgcctgagcaagattccggtattcatttgcctggctggaatcgggtttgtattgaatgactgttttgcggttgatctccgcatgctgcacaatgttatctcttggaacgaagtagagaagcttggtcccaagctcttttgaaaaggcgcggagcagatccagttcccggtctacgttccggctgttgcagatgattccccaagcctcacccctccggactttgcataccgcttaacgccttttgcaatattatttgccgcatacagggccatcatctccccgcttgccacaatgtagatttctttggcctttccttcccggatcggcatggcaaatcctccgcagaccacatcgcccaatacgtcataaaacacataatcaagatcatcggtataagcacccagattttcaagaagtcctatggaagtgataatgcctcttcccgcacagcctacccccggctccgggcctcctgattccacacacctggtccctttataaccttccttcaggatgcgttccagttttacgccgtctccctcttcccgcaacgtatcaagaaccgttttctgtgccaggccgcctaagagcagcctggtggaatccgcctttggatcacaccccactaccatgacctttttcccaagctccaccagccccgccgtaaggttttgggttgtagtggattttccgattcctcccttcccataaatggctatctgtctgatttgtcccattgataaaatcctctctttctgattcgcattataaattgtcgtataagtcttcaatcaaagtcaggcttcctctatagcccgcgtaagccctgttgaaaatcagccggtcctttatgggaaatgccgctgcgatgcactgcacctctttaagggaactgatttcctcctcattgctgcttcctatgataagggtaatatcctcctcatccaaaagagctatatttatttcatgctggtccggactgaaaaccaccttaggcggccttgcatattccagatcagtaagctcacttaagatcctgtctttgtcttcctgccggaataccggttctgatatgaccacaagcacaggagtaaaactgtaatcgttggcaagataccgggtgattcccacggcaattgacgcatccccgaccacggcgaattttttccagctcagggcaccgatggcctgtgccagatagtggtacacataatcctcctcttcctctatcaccctattaaccaacctgtcatccagctttaaggcatgagccacttcaaggataaaccgtctggtatcactggcaccgatgggaagaccgggatagcggagaaagggaaccccgaatttttcttcaaaccttccggccggccctttcaatatccaggggtgaatgataaggtttaaaaccgctccggaagatttcctgatggtttcaattccctggtgttccgtaaaaaaagtattaacctttaatccaagctttcttaacagccttgcgatctcctctaagttcccgctccaaaagggatcgtggtagggaatgatcccaaatacgtttataaggccttcttcctttgggactccttcttctatcacctgatcgatcatggcgttccagaccacctcataccctaagttgctgtctccggcaaatccaggagtatctatggggtagaccgggtatcctttttccttaaacccttccccaatgcttttaatgtcatccccgatgattcctgccgtacagcccgtaaggacgaaatatgcatccgcatcaatgatgtccaaggctccctgaatggttgactgcagcttttttgttcctccgaataccacttcccgctccagcatgttggtggaggggatggaaacgctgcttacaaagctggaattcttattgcctgactgcccctgatcggaagcagttgactgcatacagcatccaggccctgcatgataaatagggcatacccggtctatagccccaagtacggaatttattccggccagaacacagcctcctctggggttttcaattatttccgacatttcaatcacctccgattatgtatttaaatgcatcctcttcgtaccagctgtccctgtaaggaagcctgatatgctttgacagcttcacattaaaaccgggattttccagctgttcggcaattttatttcccaaaaataaaagtccgtcatatcccatggtaggccgtttcatatccagaacatgtgtggttgggattccaagctttgccgcccactcgggaactccgatgaacacatccggtttcagccttttcaccagattcacctgctcaaagggctgcatgttggcaatgtcaaggacatagttggggtgaatggcattgagatattcaatgtccgcctgggcgtcttcatcataagtcggcgtctcaagccccaccagctccattccgaaatcatcgatcagtgcggccgctgcaaaggaacggccggttccgccgcagataaatacccgttttcccttcagccggtccttaatggattccaccagaggaaggatccgttcatgctcactttttatgatctcttctccttccttttccttacccacaatccctgcgatcccacggaaccagatatccgtattacggaccccgatgggcataaccgtatgggaatatgggatgtcataatcctctttcagggttttcatgaattcatctgcaaatactttacagatggaagtggaagcctgggctgcggggatctgcttaatcttatctaaggagctgtaaaaaggaatatagtttacagaaagcccaagcaatgacagcatccgctccatttccttctgatctgcgtagcttatggaaacaggagcaaataagtttatcaggccttttatcttttctagtttctgcttttttaatatgtatttgtttatggaaataaaggccgcgtcaaagccggaagcacagattttcgattgaaagccctcgcagtgaatcggaatgatgagttcctgcctatccttctgcagttcttttactatggcatcaatatcgtccccaataatgcctgaggcgcaggaggcaaatacaaagataagtttcggatgataccttgatactgcatcttcaatggcttttctaagcttgctttcccctccgaagatcacattattctgatctaagtttgtcacaatgatccttggatttttaatatgcttcactccccggtgtgcctgccccacccggtattgatccactgccagggaggtacagcccacgcagccctggggagaatgggcgataaaaacggaatcttccagggacattaaggccgccatgctgttgatctgctggcactgcaggccctgggcaaagctccggtccgctttctttaaacagccgttcttaaaatcctcctccgcccggctgccggtagaacccagatcattgtacctgtttggatggctttctctgattcctgaatatatttcactcatggtcatgcctcctttctaaatatcaatcaataatttccggacctctgtgtaagaaagaagccttcggacagaatcctcaatatatcccggcagttcaaagacctctgtctgattctgttccagggcggcccttgcaccggctccgatccggctgaccaggacataatcacaatcttccaccattgctgccaaaagctccagctgactgtcatcatgctcctgtcccctgcatatgggagctgctttacggctttccacgtatgtgaatgtcatatccccgctgtcagcctccacgatataaaagacttcggctcttccaaaatgctggttgactacctttccgtctgttgatgccactgcaatcttatacttcacggtgtttcacctcccctttcttcaaccgtgggaaaaggtatcgcttcctgcgatccttctctggtatatcatgtctccgaaatcctttcccccaagcatgcccactgcatcggcacggcagtgctggcaatggcggaagacatcaatgtgctttccagccaaggttctggcctcatcgatctcctggcatacaggtgcggtttcatgggaaagttctgattgagggatcagggggataatgttgtagatgcatgcgcctgcctcttttacggcctttgcaataacctcaatgtgttctccgtttatgctgggcaccagcacggtgttcacctttaccgtgattcctgcatccgctatttttctgatgccctttaactggttttctatgaggatctcggctgcctggactccctcataaatatgtccatggtacaggatccaccggttcagccttgcttcgatctcaggatccaccgcatttaccgtaacggtcacggattccactccgatttcaatgatctcctccgcccgttcatagagaagaaggccgttggtgctcatgcatttgatcagctccggatggtgttcctttaccagacggaaggtttccagggcataatccgtagccagggtatcacccggccctgcaatacctgccaccgtaatctccgggcaaagggcaagagctttgtcaaggacctccaaggcctgtgaaggagtgagcaccttagaggtcactcccggcctttcctcctggtcattgatccttctgtcgcagaacttacaggaaatattgcagccggggctcaccggaagatggatccggcccacattgtttttatttcctccaaagcatggatgtgacttttgcaggttttgatatgtatttgccatattaatctctctttctcagctttcttatatttggatacaaaaaagacaaccttctcctgatacgcattttgcttatcagaacctccggttgtccagtcagtcctttaatccgatattttctttttttatctgcactatttttccatcctgaattatgatggcaatggaaccatactttacacgtccggccatttcatggatcagcctatggattctttttcagacggttcctctttatatgtacctgacgttcccttggtatttcctgcatcgttttgttcctgtgaaatggaccaacggtatagttgatgaattttatcatcaatttctgcttataaaaaaacaggtactattatagtacctgtcaagcctctgctgcggatccaggtattctaatacatacaaaaataagctgtattcatatacatgcacacagttttacaacaacagcaatccatcttttcaatatttgaaaaatgattcgtcctggcagtaaccattgtttttttcatatgaatagcatcctttcccgatatatcctattattctcataggttttatatgcattgattataatcttatctttttgggatgtcaacatctttttcacatttttatttaattagtaaatcactttataaaatgtctttatagattttcccatccttcatgatcaatttcatattgttcctgtccgccagtatatccagattctcaacaggattcccttccacaatgcacaagtctgcaaaggctcctttttccaatactcctatttttccttccggatagggattttgataggtcataagctttgtcagctggtaaatattccctgttgctgccgcaaggcctttgaaactgccaaatctctttttaaaaaaggtaaaatcctctaattgatatttatctacccgctccgggtctccaaaagaatctgttccaaatagtataggaagatcatatttatggatcagttctgtagtaagctcttctccctgccttaccatggctgattttctctttatatattccggtgtagactcattatgccagtttctgccgcactgggggccggctgttacccatattccattggcagctatgatcttagccgtttcttcatccatcatcgtcgcatgctcaaagcttttaaccccggctcttgcggccctttgcatggactgtggcgtataaagatgtgccatgacataagttccgtagtccgatgccgctgaaactgccgccttcatttcctccagggtaaactgtacggtctgaaccgggtcataagcagaagaaatcccgcctcctgccatgatctttatttgggaagctccaagaaaaagctgttcccgcacggctctcagcacttctgccactccgtctgccaatacggtgcccttactctgcaaggcagcagaggtatagattccgtcggtcagccggtattctgcccggcttgctcttgtatcaccatgaccgcttgtttgggaaataaaagcatttgatgggaatatccttggcccttccagatatccgttatcaatatttttctttaacccaaaagtcacgcctcctgcatcacgaaccgttgtaaacccgcgaagaagcatatcccgggcaaaccggacggaacggactgcattttcatcctgcctcatagcatcagatatacctgctccgttgaaaaacaagtgaacatgggcatctgtaagccctggtatcacggttttattttttgcgtcaataatcctgtcaaagcattcctctgaaaactctcctttcaagatctcttttaccaggttgttttcaattacaaccgacgcattttcctttaattctatatgccttccatcaaatacaccggcattttttattaatattttcatatgcttacagttcctttctgtatcttccaagacgctgttccagggcattgccgccccattgaatgatcaggctgaacagccagtagatcaaagctgccgccagataagcttcaaagaagcagtaagccgcgttggcatattttaaagcaccgtttaatatgtccatcactccgatcaaaattaccagggaagtggctttgataatagaaataatgcttcctgccaggacaggaaccagaaccagtaaaagctggggaaaaacaattcggcaaaatgtctgattaggggtcaggccaacggaatatcccgcctcatattgtccctttggaatagaagcaagggctccccttatattttcagaaagctgggtggtacaggtgaaagacagtgcaaaaactcctacatacagcatatggatatcatttacccggactgccagaccaagcgcctttgcaaaatcattaaacttcatggcaaatacaagtcctgatgcaacgattaaaagattaacgggaaccgccttaaatataacaacataaagatcaaggaaaaaagatagtcctttgatccgatatgttcttccaagggcgatcagcgtcccgaatataatcccgataatcaggaccagtgctgcaatatacagggtgcctgggatatatctgaccgcgttccagaaacattccacaatataatttaattttatattcatattccttacgcctcttttattttcttttcataatttaactgttctgaaagacagacacaaaagcgttcaagtataaagctcgccactacaaagataactgccgcacaaaagtatccctctaacgtatgaaatgtaacggttccaattgccttgacctttcccatcatatccgtgacacccagcatataggctaaggaagtggcaggaagaagtcccaccagcatggtgctgaaaccgggaagcaaaacgcggaaggcctgaggcatgacgatccgataaaaagtctgggttccgcttaatccgacggagtatcctgcttctgcctggccagcaggcactgataatatcgctgcccgtatatgctctgacaaaaaaccggcttcatttaatccgtaggctatgtatacaaaaatcagtttattccattctgatgtgatattgtttcccacaagggccgtaatgaaaaggggcattccataatacaccagaaacatttgtaccagaatgggggtccctcttacaaaggatacatatacggctgacaattggtttaatacaggcagtcttttgatacggatcattgcgatagcagttgccagtacaatggcaattgcaatggaaaccaatacaatgtttaaggtaaccggtaattttgagagtacctttggaaaatattccattacccgctgaaaggaaaaaaaatcacctgccatgattatctgctcctttctatttatttacttagatctacggtataatcggcgcccagaactttttcggaaagttccttttgccagccggaatccagcaattcctgctgtattgcatcaatatcctgcttaagctgttcatcgccgtaattatagataaaatagcagccgttcagcttatcagggctataaaacagcttggaaccggcaacatcaaaaatatctccatatgccgctttatccagggcatctacaaatggtatactgaggagcccgtcgtaaataccgctgtttaagcctgccagatgctgttccgttgttccgtcatcataaataacggtaatcgggttatccggatgctccgtgttatatttttctgccaagtaagccacattggaagatgtctgtaccgcaattttaagtccgcctaaatcttcttcacttttcactgatattcctgagccttttgcaaccctgaaattatatccggtatcaaaaaaattccctacggttccatataagtatttttttgcccgttcttcattccagccgtaatgatgcacagcaatatcataattatctgtatcaagacctactaaaatatttttaaattccgtaggctcatacttaaattcatattggggaagctgttcatctatcttttttaatgtctcataatcatagccctgcaaatctccattctcatccacatagcacatgggattaaagctgttgccaatcccgattttaatggtttttacagacgctgatgattctccctttgctgtgctttctgccgatccgccgccagcaggcacatcaccttttaaactgcatcctcctgctgcagctgccataacggccattaataaaactgccaaagccttcctgcatctttttacacattttttcattttccattcccctttcttgtatttcttattaaataaacagtcatatttctgttcatcagcgatgccggttggatttgaaccaacaatctaagttttgcagactcttgtcttttccccctgactacggcaccttatcctctgttatctaagtcatggaacggacagacttccctatggtcatacattcacatacttccagcatgatacttcatgagtcccttcttccaccggcggaggttcctgcgtcttgcaccgttccatgcaatcggggcacctgccggaaaatctgcatccctttggcatatcaccaagaggcggaaccgttccttcaatggaataaaggtcctttatttctccgtccagccttggtatggatcttagcagtcctctcgtatatggatgaagaggattggtaaacagttcctttactggggcatattcaatgatccttccagcgtacatgacagccacatgatcggcaatctcccatatgactcccatatcatgggtgatcaggagaatggacgttttcaaattctgatttaattctttcatcagctccagtatttgtgcctgtatggtcacatcaagagccgtcgtcggttcatcggcgatcaaaatcctggggccggaagaaacagccatggctatcatcaccctctgtctcatcccaccgctcagctgatgaggaaatgccttcatccgctctgctgctgccgggatccctaccatgccaaggagctccagccctttctcataagcttgttttctggtgatcctgctatgggccctcagcatctcggtcagctgtttttctatggtatatacgggatttaaagaggtcatgggttcctgaaagatcattgaaatgtgctttcccctgatttctctcatctgcctgctgccaagtcctgccagatccaccccgtcatataggatctgtcccccgcttattcttcctgttccctggggcagaaggcccagtatagaagaaaccgtcaaactttttccgcagccggattctccaactattccaagtgtctgacctgcgttcagggtaaagctcacccgatccacagctttcaccgttcctttgtttgatattttaagttggatctccaaattttttacttccagtaatggcctgctcataggaagacctccttatcaggacaatttcatcttaggatccagggcatcccgtaccccttcacctataaaattaaagcttattacagtaaatatgatcaggaagccgggcggtatccacatccatggcctgagcataagattgcttaaattctgagcggcattaattaagttcccccaagaagctttgggcgcctgaactcctactccaaggaagctgagtcctgattccgttaagatcgcgcctcccacccgaaaggaaaggatcacccatacaggtcctgcagcattaggaagtatttcagtaaaaataagggaccaattatttttccctgccgctctgcctgcctctatgtactctttcttactgatggataacacatttccgtaaatcagctttgcaattgcggtccagcccatcacacctattattagaatcacggtaagaagagagggtcctgctacggaaacaagaaccagtatgaggatcatactgggaaaggacataaacacatccgcagtccgcatgactcctgtttcccatattcctctataatatccggcgagaagccccagcggcagaccgatggacacactgatgagagtggatataatgccaaccagcagcgataccctgcccccatatatggtgcgggcaaacaaatctctgccagcagcatccgtgcccagccaatgctttagagtagggcctgacaaaaagccagcctccccgtcgctgatgtacggatccatgcgaaagatcagaggaaaaagtacaaccaccccaatctctgccagaatatagcacagcccgagcatcgcccttttattttttttaaagctttgaaaaagagccgtctgcctgccattttttctaaatgccataattaacaccctttcctgtttaaccataagtaatcctggggtccagtaaaccgtacaaaatatccagaattatgttggttattaaaacagccgttgcaatcagaacggcgatccccataacgaccggataatctctgttgctgatggaggcaatcatcaggctcccgatccccggccagccaaagatctgttccgttatggttgagcctcctatgatatgtgggatctcaagaagcacggcagtcaccacaggaatcagtgcgttgcgcagcccatgccttataattacgttccattcactgattccttttgacctggctgttttcatatattcctcattgaatacttccaggcaggcccctcttgtctgcttgatcaggcctcctattgaaccaaggcagatcacggaagcaggcattatcaaatgaatcgcataatcaggaatacttctatcggaaacctgatacatgccttttgaaggaagcattccaagcttcatgctgaaaatataaattcctaaaatactgataaaaaaaccaggcagcgtagctcctgccagcgccagaaaagaagaaacagaatcccacttggtataaggtttatatgcggccatgatcccaatgggaatccccagcaggaccgcgaaaaaaactcctgtccccgtaagcagcagggagggaaatattctttgggatatgatcagggatacttcctgattgctccggtaagacacacccagatctcctttcagaaaatctcccagccagataaggtatcgtacagccaccggcttatcaagccctaaggaagcctttaaatcattatactgttctgcactcagcttggtatcactgtctgtcagaatgtccagcgcacttcccggagccaggctcatcagtatgtaaacaactgctgtaattccaataaatatgggaatgccagttaatatccttttgacaatgtacctccacatggtctgctccttactattttttcacccattcccatacattatcattgcacatgccggcagcttcgtaatccacattctcaatggtctgggactggacaaaaatggttccggagtgccagagagggataaatggtgcattttcaaatacaaaaacctgataatcgtttaacagctgctttctttttgcgttgtcggtctcatcgtatatcttctgccgccactcatcataagcaggatctgtaatggaaaaatcgtttttcacactgctgctgaaattattggcaaaccacagcggataggaagttccctgatgaccggaaataccgatatcatattttccttcttttaagccggtaaacatggttgccacatcgaccgtaataatttccacctgtatccccgcttctgcccactgctgctgcattaaggcagcaagactggaacgtgattccccgattgccattttgtataccttccccggatcataacctgcttccgcaagcagcccctttgccttatccaagtctctgcctgtactcaagtctttattataataatcgctgcctggaaggacataagtagcagaagctgatcccagcccctgagtactcgccttagccagcacttctttgtccagagcctcattcatggcaagccttatcctaaaatcggagatactgtcattgtttaagatcacttccacaaaattagatttggccttggattctgtaatttgaaaaccagaggtctctgctacttttctgtcgtcctggttattgatcccgtttccaaaggcaaaataatccagctccccggatatcagggaagataatgtgttagaagaagctatgacattaacgacaagccttccaaatccgggtgcgcccagataataatccccattagaccggaacacaagctgactccccacgatttccgactcataaatgcagggacctgagcccaccggagctttccagtaatcggcagccttaatttcgtcaatgctgtaattttccagaagatgcttaggaagaacatagaagttccggttatacaataccagaaagtcttccggagaaagcgggttctttaatgtcagcttcaaggtataatcatcaggcgcctctgcttttacagatccttccccagtagcttttcccgaactgtccgtgccttccagaaaactgaaatagccgctgttgcttaaaaccagatccgggctggtaatcagatttatggtataaacccagtcagaagctgtcaatttttctccatcctgccattttgcgttctggtttaaatgaaaaataatggtttttccatcacccccgctttcccatgagccggcattcctgggtttgatcacctggcctgcctggctgacaaatgccagtctgtcatatatcttatcccagatcagctgggaatacatggaacctgatggggagtcataaggatttaacgtatcccaggcagtagacatagcatagttgacagtagagccctcaacgtccttgggatcttcagacgttgtctgtgtactgctctcctttatctgaggctcatccgtattggtgcttttagaggccggagagctgcatccggtcagaagaacgcctgcaacgtataccccagcaggaatgatttaaaatgtctgttatttttcataatctcctccattctgccgttcaagcggcatttataaacgattttatttcaactgtgtatgttaaaacaagcagctttatggtttgccccggccggtaaaagcccgggttctgatttctggcatcgggaatccgcgtaagggcaccggtttctgaaacggcagccggctaaaagctccaagggatttggagcctctccctttaatatgatccggctcatttttacattgacatcaggaacgggtatggccgacatcagagccattgtataagggtgagccggatgttcaaaaacttccttttttgatccaatctccacaattgtcccaagatacattactgcaactgtatcacacagataccttaccacacttaaatcatgggagataaaaagataagacagatccaattcttcctgcagctgcttcatcagtttcatcacctgggctctcacagagacatccagggcggataccggctcatcgcaaacaacaaactccggcttcatcacaatggctctggcaatcaccgccctttgccgctggcctcctgacatctcgtgggatatttatgaacctggttttcctgcaacccaacatgcatcaggatttcccgtaccatatcccttcgtgctttctcctgctctattttataaacatccaagggtgtaatcacggattcaaaaatcgttttccggggatttaaagatgcataaggatcctggaaaataatctgcatattttttcttaaaggcctcatcttttgaaaatcataggattctattcgttgtccctgaaacaaaagctttccgcttgtaggttcctgcagcttaatcatagtccttccaagggttgatttgccgcagccgctctcgcctaccaatcccaaggtctctcctttatgtacagttaaatcgattccgtcaacagcctttaaaacctttttcttccccctggataagcctttatttacaataaaatgccgggacagctcatctgcctcgatgattatctggcgtttatccataagatcccctttcctccccgcccgccttcatttgaagctttctgctgccgcatatctttacaaatgcttcgaacatagggctcatgtcaattccttccggaggatctataatatctccccgcattctttccggatgccattccacaccgtaaacaggcagtgtatcatgttcgatggcttcgattacacggtcattggaataagcggctgcctttaaggacttgccaaggattccgattttattattgtgacggctgtttacatagaattcttctccaaacagctcatgcaaaagagaacctttttccgtttttacagaatgctggatgagcatgtgctcgattccttccgtatatttaaaattccgtattattgtgccccctgctgctcattgattacctggtgacccaggcaaattcccaaaaccggtttttttgcttttacaaatgcctgatagatggaagcatcaaaaatactccttttaggttcctccttctggaccgcctctgaaagctccggttttggtgaaaaggaaacagagcccgttaagatcaggccgtcagccttatcacaataatcctccgtcagttcaagctctatgggaagcagcggaactcccccggccgccgccaccgctgtggtataggttttattgaccattacggcaggttctaaaaactgcctgtcataagcaggacctccgcagatcagaatgactggtttcatgcttactccgctcctttacatatttgaataaaataatgaaacagtgagtggttttgtgccccggtattttcattaagagggttccatccgattcccagtatcgggagatcatcgtgttccaaagcttctatgcattccttttccgaaaatgctgtgggccgcatattgatccccaatttactgattccaggaattttaaacagctccgccggaaagctgcttcctgacaaagcaaagagtctgctctttggctccggatacacaaatttcagttcccctgacagatcctggtccaattcttttttctttttactgtcgggtaaataaagagtgcctcccaatgccgtattgatgacctgcatgcctctcccgatccccaaaacaggctttcctgcttcagcaaacagggtaaatagagtaaattcaaaatcatctctggtagaacaaatgtcccgcatttccttaaaatccgtataatactggccgtaacggcctctgtgtatgtcgggaccatgggaaaggatgagcccatcagataattctacatattcttttgccatccgtatatcttccggcataaacggcaggcctccgttttttgcagcatagccggtatattttctgttcatgataaaatttgccgtgccaaaagaaggatcaaatccttcttccccggtaattaatataaccggtttccagtccttatcttcttttttcaaaataacacctctgtcatggaataatcaggttcaggctaaagaatccgcccagctgccactttaatcgcgttttctcagctttctttctcaaatcaggatacaaaaaaagacaaccttctcctgataagcattctgcttatcagaacctccggttgtccagtcagtcctttaatctgattttttcaattttttcgatctgcactatttttccatcctgaattgtaatggtaatagaaccatactttacatggctggccatttcattgatcagcctgatgtattctttctcaggatcaggagcatttgaataggatatgggaatcaccttctctcacttatggatcgctgccgggcctgtatcttttccaaggccctggttctttttctcaggtggttcatttttatatgtatctgacgctctctttgtatttccttcatcttcccggccgcgcagattgatccaatggtgtaattgcatttgcaactatatttcctgaacgcggagtgcgcagtcccggaaggtttttatatcagaggatgtactttcccatgatataaaaaaaacaggtactattatagtacctgccaaactcctgctgccacggaccaggtattctaatacatacaaaaacaagctgtattcatacatatgcacacagttttacagcaacagcaatccatcttttcaaagcttgcggaatgattattcctggtagaaaccattgtgtttttcatatgaatgacatcctttcttagaataccctattatttttataggttttatatgtattgattataatatcatctttttaagatgtcaacatttttttcataattttacgatatttttttaacaacttgtccgttttatctctatttactcactgtttcagacttccgtcccatataaaataagacgtgatgaaagattagcactctgcatggaaaaatgcgacaggatcattaaaaagtgaataaaaccgttgtccttgccggtatttttataaagcggaggcacgtatcaatgcctcatcaatgcatcccgcaatattttctcttcccatatcctctaagaaacccgctttttccattacccacatcggctgttcatttacatgggacaataccagtatgacattttttctttttaaattgtggtaaagcttctttaggctctttaaagcggtggcatccatagccggaacgcttctcatccgcaggatgagcacccgctttccatcctccaaaactaccttggatatcttgtcggcagctccaaagaacatgggaccattgatctcaaatacggccacatgccttgggacaggctttaaatcaacagaatctccgtcacaatcctcttctccatcctccagatatctccagccgtttacctctgccacatctgccatccgcttcatgaacagcagggaggcgaataccaggccaacgccaatggccatgacaaggtcaaataccacagtcagaacaaaggtaaccaaaagcaccgaccaatcgcttttaggtgaagtctttacaatggaaagaaactctctccactcgctcatattataggcaaccataaacaggatcgccgcaatggccggcatggggatgagcgccgcataaggcatgaggaatatgaggatcagcaaaagaagaactgcatgaatcattcctgccactggggtccgtcccccgtttttcacgttggcggcggttctcgcaatagcgcctgtagccggaattcctccaaacagggcggaacaggtatttcccactccctgggcaatcagttccatattggaattatgcctgctgcctatcatgccgtcagccaccacgcaggaaagcagggattcaatggcagccagtaaggcgatggtcactgcatccggcatgaccctctgcatcatggaaagggacagtttgggaatgtggaaagccggcagactgggcgaaatggtatacaaatcaccgatggtgtgaaccggaatatccagcgcctttaccagaacggcagtgagaatgacagcgaccaaagaaggcggcaccttcttaaaataccttggccagatgatgagtacggcaagggcagtcattcccactgccagtgccatgggattaaaggttcccaggcagctgatcacctgctccagcttttccatggtctccaccggcgctttttcaaaggtgagtccaaggaaatcctttatctggccgataaaaatcgtcactgcaattccggtagtaaaacctgtagtaatggtatatgggataaaacggatcaggcttccaaggcggaaaaaacccataatcaccatgatgatcccggccataatggttgcggcagccagaccgtcaagcccgttctttaagacaataccggccacaatagaggcaaatgcagccgtaggccctgcgatctgcaccttgcttccgcctaaaagggagatcacaaagcctgcaacaatggctgtataaagcccctgctccggtgtcacgccggaagcaagggcaagagcgatggataggggcagagcaatgatcgccacgatgatccctgaaacggcatcctttacaaactgctcccttgtgtaatgcttcattgataaaaaaaactggggataatatccttcatcttttctgttcctctgtatagtataaattttttataaactttttataatataactgtgaaaagaaaagaatgcaagggaatttcccatgttctttaaataatacaacaattcttacctcagactgtcggcagccagcagctccagccccttttcatcaagcaattctacgcttcctctggtgatttttaccaggtgatccgtctgaaacagccgcaagagtctggtcaccacttctcttgctgttcctaagtgatgggcgatctgctcgtgagtgatggaaagttctctggagccggtaagccttccctcttctaaaagaaaggcagccaggcggccatccatttttttgtttaagacctgatccatcagccacatgacatcggagaaacgggaagccatcagctcattggtaaaattagagacaactgccgactgctccatcagcttcttgtaaacctccggcaataccacggttaccacagagtcctgctccgcttccaccgtcacatcaaactgaatgttttttaccatacaggggccggaaaaaaggcagatatccctctcaagcaaacggtaaagggtcagctcccgcccctcatcggatatcataaaaactctcagctgccctgccgttacaagcaaaagcccgctgcagccgtcagccccgccatggaccagcatgcccttttcaaaccggacttccctggcattttcttttaagagcattctctgactctccgtcagcttattccagaaaggaaggtattctcccaacaccatatcatcaaacctccatgcgcctaagaactttgaaacgtaatttcatcattgcagtcaaagagtgcaaaacactcctcatagcccagtcttccggatttcagttcttccgccatcagaagcagattcatggaattgatcgctgccccgcagattcccgaacgcatccggatgttatcaagcctttccttaaaacctccggtaaaggccccggaaacaaaagcaaagtgataccgcaccacacctttgtcaaaaatttcccaccatttattcggattaagcttctcgtcccgtttcttattttcctctatgtagcggtatatctcgtcagcctgtttaatgggaagggaatacccctttccataagccttattatcaataatcagcccgtcttctccgtaatacacgcacacatccggttttctggtatcacccagcctggcccccttaaaatccagctcagccgtcagcagctgggccgtctgtatctcataatccctgtccgaagtgccgtcaaatcccagatccaggaggattaaatacttatgatccacatgggtcaaataagaccttaaataatccttgcaaagggatacctctgatttcaccggcaccggtccaaggcttgcggcaggcaggtccaggccggttatttcctccatgatccggtaggtatttccggtcctttttacttgaaggccgatattttcaaggcttcggatgtcatcaaggatcgtctcttcctcttcttccatgccaacgccctttaaatactcctttacctgcaaaggagagcggtaagccccttccagatactttataatatgggtcctcctgctgcgcagatattcccggtcagccaccttggtagccagcatgtcccacatcacccgcttgggaattctgggaaattttgaaactccggtaacatgctttaaaatggtcctgccctttaacgtcagctggtaagactggggatggttcctgtataagtccgccctcctatggaaagggatacctcctttgccaccttgctgatccagcccatctgtaaaagccagctgcaaatggtcctgacgtatttgtcactggtgccttccgtatcctgaagaagctttgtcttctcttcttttgtctccgcttccgtcagcccctggaggatcatatactggggaatggaagtaaagcctgcctctccgatgaaaccaagccttgctccgatctcaaattttgtcagatgcccttcttctcccagcaaagacagaaccctgcatacgggagggtaagaaagaaatgcggtttttaacgcggaagcctcctcttcgctgccggcaggtgcatccgcatacagccgtcccaagggagaaagggaacagacatcctctttccggatgtaatgaagaaaaccaatgctgactgcccatcttagaaaggaatccgcaggccagtcgctttggtattctttccgctgtcccggcagcactgcctggatgatcccggaacagggggcattgcttcttgtatagcccacaggtgtcccctttccctttaaatgggtataggggatggaaatttcctctccgcctaattcccgtataaactcatctctcccgtctttttccgatatgagcctggggatcttatccatgcgcaggatccggttgatctctgaatcaggcacaaacgcggataccacattttttaaattatccagggtataggcctcctgtacccagccaaatgtacgatctgccactgttaattcctctctgcttttccttttttctgccgctgttatccgtgcaaagctcaccctgcttcaccgggtgtaaagggatacccatagggtgttttctttagtataccatagcctcccgggattgaccatgtcattttccatgtaaggagcaatgggtttgatttgttatgacccttttcttgtgatataatggtggaaatcttaaaagacaggatgggaaaggaacagagattatgggaaaattacagatgacaatactggcttttatggcaatttccggctgcagccatatcaggcggcagctccgggacagagattacataaggcagctgtttttaggaaatgccgccggaaaaagcaggatcctctatctggattatgtgcgcctgactgctgccgtttttgtcattttggtccactgcctggatttttccacggctgaactcccggaaggaacagcggcctgggtggcagcacagtctctttcctccgtccttttggtctgcaacaccctgtttatcatgaacagcggcgctttgatcctaagagggcaaaaggaggggttcatgaccttttattataaaagatttcttcaggtggctcttccctttttctgctactactgtatctatatcctgctttcctgccagtatttcaattccggatttataagcggggccgcaaaagccttaaaggatatggcggcaggccccatcgactgggcgccccatttatgggtgatctatgtcattttatccctctatatcctggccccgttttttgccatacttttaaagcagctgaccgattccatgctgcatgggctgtcggtcctgattctgctctttggctgcctggcagtttatctgcctgccatgggcctgcccctaaatcttgagctgatgatcagtccatgggaaggagtatttttgcttggatactacttctcccagcctatttctttaaaatacaggaaagcctggtgggggcttggcattgcctcctgcctctttaccatcctgtgcgtttccctccggcctgattacaaggccattctattggcaaagggcgctccggccatgacgattacaggaggagcagtttttcttctgctccgttccctggaaaaccggcttccaaaaccagggcttctcatgggctttctgatccggtacagttattccatcctgctggtccactgggcgattctctattttgtcagggaacggcttcccataccctggcctgcctttggaatggccggcagcaccatcctgtcctttgtcctggtgctggttttatcagccggagctgcttttctctttgaccagaccgtggtcctttgcgttcaaagcctttttaaaggtctggcccggccatttaagaaccaatgagttttattcttccagttctggtgtccgctctgctccaatgggtcttacggtgattccgttgatttccacatgctcgctgatgccgatcacgatgcaaggacggccgtcgatcatccggttttccaccaaatgagtcttatcaggcgctaccttgatgcttacatccgcagttttgatctcaaagcttctggtattgaccacattggtggcaaggaagggggtactgactgttcttcgttctcccatagcgctgttcaaattcttccagcttttcctggctggctccgttgttctccaaaagccgtttcatctggtacttgtccagggtaaagggggccggttcatcctttgtttcctctaagatctcatttaagttttcatgaaggcttttgactgtctcaaaatcgcagttatctcccagggtttcttccacaatggcctggaacgtctccttctggcttttggctgacatgggtatgatacagccaagcagctcgtcgatcaggcgctccggcatttgctccgggtttttggcatagtataaaaggctgtggatatctgtatttctgtccgtaaaggccggaaataaaaatccggtatcaggagcctctacgatccagtccctgctgcggttttcgatcacatttgcctcagtattgtagcaaaggcctgcctttgacagctttaccggacaaatggtgcactggaggaattcataaacaaaatccgaggcatcatacatttccaggccatctgaggaccttgcgggaatgtcgtaggcacaatggatgaggatgatgtaaaaattttcgccaaaatcgtagcttgcaatgaccttatcatagaattcctcaatcagcacatcatcctttaactggctgtcccggagctttaaaaggaaattctgggttccgccctcttcctccgtatgtaagggaaattccatattgaccatatttttgcccatggttcctgacagggcgcttctgaaaatggtgaagtacttaaacgcctcttcctccgggagggataaaaatgcctccttaatctccgtccgtttgttcttttccgcgtccacatagcagccgcagatacggctgatggcgcagttggccggagtaaaaagtttctttatttcattggcttctttcttattcattctacggtcttctcctattctaaagtaaagctgcaaaataatactagagcaaatcagggcagaagtcaagaattggtatcattaaaaaaactcacagaccgtcaggcccgtgagctttttcacttcttcttatttatctgctttccataatccgtgaaggttacagtactcgtatgcagaaaccacttcatctccgtcgcaaagcatgaattcagcaaccggtttctctcccgggcttaatacctttctctgattgccctgcttggtctctaatgcgatccagcctatgtaatgctcaggaagcattggatgctcaacggaaccaaccgtaaccgttacatgctgtccgtcaatctcaattacaggaacgtgtttctctgttgcagcatctgttgtattagctaccaactcgtgcatattttctccgcaacatgtaatcgtaccgcctttttcctctacaaccgccacaatattgccacaacggttacactttaaaaacttcatagcaattacctccttcgtcttttgaatctttattgaattatattctcattatactataaaattcaataattttcaatagattcaaagaccttctcacttaccgcatcgttcttggtattctgagggcgatacccccaaaagctttttaaactgcacgctgaaataggctgtgtccgaataccccacctggtccgccacctcataaaccttgacccggcagtcctttagcagggacatggctacctgcatccggtaaagggtgagatagctggtaaaggtataatccgtttcttttttcagcacacggcttaaatacccttcgctgatttctaagtattccgccaccgtactgatggtgatgttctcctgataatgcatccggatgtactttgtggcttcatccacatatttgttttttgatttcttgtccgcattaaaacggagcaccggtgccgcctcctcacctgccgccttttccataccctgctccatctggctcctgatatgaaggatggcctgctctaaatctccatcctttaagggttttaagaggtaatcactgacccccagacgcagtgcgctttgagcgtatttaaaatccccgtaagcagtcaggataatgaacctggctttacacccttctgcccgcagcttggtgatcatctctaccccgtccatgcggggcatcttcacatccgttacgataatgtccggggaaagccgttctgccaaatgagcgccttcctccccgttggcagcctcgccggctatgacacagtccagagccgcccagttaatggtcaaaatgattccccggcggaccattgtttcatcttccacaactatgaccttatacatccgtaacctccctctggaccggcagccttaaggcaatggtggttccctcctttgttacctccgccctgatcccgtattcctggccgtaatagattttcagtatgcggatcacattgtaaagacccaggtgcccatcccttttaaggggattgtcactgttgatccagtccaccatttcctgatccatcccacacccgtcatctgtgatggaaatgcttaacactccgtctttctggtctgcaaaaatgcagatgtatccgttttcgcacccatccagcccatggatgatggcattctccaccaatggctgcaaaagcattctgggcaccatacaatcctccagctggtccggtatctcggtttcatagaggaaccgccccgtaaaacggattttttggatctgtatatagctttcaatggtttccagctcctccttcaaggtgatgaaggggcggctggaaatgctcttccgcaggattaccgctaaattctccgccaaaatggcgatttccgggatctgattgatcctggcattccatttaatggtgtccagggtattatagagaaaatggggtttaactgggtctgatacagtttgatggtggtcttatttaaatccttttgcttttgaactgtgtcttctaaatatttctgcagatcccctgtcatctggttaaagctttccgtcagccttcccagctcatcctgtctgtttgtatgaatgcggatggataaatcacctttttttacctttgccatagccttatccagctggctcaccggctgggcaatgcctctggagagagcaccggaaatcatcaggcagaggatcagccccaaagcagataacagaatgcttactgtgcccatggtgcggatggccccggcactgactggtgcggaacgccttaagatgacatagattccatgggagggttccatggtccaaaaatatctggtatacactccccttcccttttctccctcctgtccggccactccatgaaggatgatgtcgttgatctcctcatccccatactccggtcttgagcagtaaatgggcctctggtgggaatccagcagcaggaacgtatcccctgaggaataaaagccatttagcaaattgtcaaaattctcccgggaaaaatccagaaccacatatccggttctggctccatgggaattttccagagaataggctccctgcatcagggtgtttttatccgtttccggaagatagggatcagtcctgtaataggtaattcccttctccccctgagccttccttaaaagcccccaacgaacagggagggagctgtttttagaagcagtatccgttgtaaaacgaagctttccccctgaatcataaatgctgaactgggcgctgctgtatatttcctgaaccgcctgatataaagataagtacaaatccttctgcatctcaatggcatccttatcgatcatcaccctggctgctgttccgtctgctgtaaacgcttcacaggctttttcgcagttttcaaataactgggtgagctttgtgctgacctcctccagctgccggtttccttccgccgccatctgtctgttaatggatgcagtaaaaagcctggtcactaccacgctcgaaaaggtaagaggcaccagagctaccagcagacagccaaaaaacacccgtgttttaaaagaaaaccctcggtaccacttcatcctccggccctccttttatgcaaagacaggaccccattccattgttttaaaatctcctttttcccccgggacagctcctttaaatccatattaataacaggaagcctgttcactggggaaagtccgggaagaggaggcacatccatgcgcacagagcgcctgtttaaatccgaaacaaggatcctctggacatccttactgacggtgaaatccacaaaacgcctggctgcctccgggcggggcagccgtttacaatggccgttccctccggaagcaccgttgtcccctcttttgggtaaatgtagtccacatccgctcctgaggagcgcagggcatgggctgctccctctatggttaccccaagggaatacctgccgtccagaatgccggaattcacctcagataagctgaaaaggcttccgtattccaggttatccgccagatgctccatatagtctccctctccccggtatgtataaacagctgccgccagagccgaggaatagatatcagaccgtccgggatccataaaagccacccggcctttccatcttggctccaacaggctgatccagccttccggcacctcccggtatgtcaccacattggtgttgtacatgatgaccaaaggacaggcggaaaagctggtccacttatggtcctgacaacggaacgccccggctatggttgaaatttcaggactttcataagcctgccagtattcctttttctcttccagggtctcaattcccacaccaaataccacatcccaaatttctccgccatcgccgtatgggccgctgctgtcctccagagtttttaaaagctcctctgaggacccggttaccaccttgacgttcaagccggtgcgctcctcaaactccttgacaacaggctcacagatccctttctcctgaaccgtataaaccaccagatcagaatgggaaagcatgggcggctctcccgtttccggctggcaggaagacagcaggaaacagcaaataagagacaatgcccagaccgccggccattttcctttgatacccttaaaaagtttcatggataccatctcctctcccgtccctgatacagatttcttttatccattatatcaaaaaaatgctcattttgccatgggcataggaccgcatttatggtaaactttacctaatagacaaatggaggtgcctgccatggcaatacatattattgaacaatccattatctcaaaacacaccggaagcagcctgtgtgaagatggactgtttgtaaatgaaaattttattgccgtcatcgacggagttacaggcaagggcgtgctcacctggcctggcggtctgaagcctggttcggaaagcatgaccagcggccgctatgcaaaagaggtgcttgtgaaggctttatcgtccatgactcctgatatagacggagccggtgccatggactatttaaatgaagctctggcccgggcctgccgtacacgccgtgacatccttaaggaaacacccgaagaacgcctgcaggcagtgatcatcctgtacagccaccgccgcagagaggtgtgggcctttggtgactgccagtgtatcattaacggcatccctcaccaccatggcaaggccattgacagcctgctttctgaggtaaggagtctttatattcagacggagctgctttcaggacggtccgaaacgtctctttcctgccacgacaccggacgggaatacatccttcccctcctgcgccgccagcttcttttcgccaatgaagactctgcctacggatatgatgtattgaacggtttctccatacaaccggatcatgtcatcatctatcccgtacctccctgctcccggctggtcctggcaagcgacggctatcccgtccttaaagaaactctggcagaaagtgaggctgtactcagggagcttatggaaaaggatcctctctgctttcgggaaaacaaaggcacaaaagggctggttaagggaaatgacagctttgatgaccgcacctatatccgctttgatactttatgaaaaaagcacagacgggctgctgcaaaataatgattccttttgcagcagcctttttatttttctatcccgcctgcagacccaaatactcctcaaacaagctgcacacgcttacagaatccgcctctgcctccatctcgcagaagatccgcagcagcggttctgtaccggagaatcttgcgatcacccagccgccgtttttaaagtaaattttacagccatccatataagagattttgtcaatttcaaaaggcagcaggggaagctcccggtcaatcataaggatccggctgattctctccttttcttcggctgtaaaacggtaatcccgttccgtcatatgaattgctccatactcccggcggatgtctgctgcaatctcagacagctttttcccggatactgccatcatttctatgagaagggaggcggcatagattccatccttgccatgaatatgacccttaaccgtaaggccgccggaggactccccgccgatgatggcatctgtctcctgcatctttgcggatacaaacttaaatccaacgggaacctcatagcatgtttgtccgaagctttccgccacacggtccagcacatgggtggtggaaaggcttcggaccacaggcccgcgccagcccttatatttcagaagatagtaataaagcatcaccagaatgttgttggcatgaaggtagcggccctggtcatcaatgacacccagtctgtccgcatctccatccgtggcgattccaatatcgcagtaacggtccagcacataattctgaaggctccgcagggtctgctccgtaggcgcaggcatttttccgccaaacaacgtgtcatgctggtcgttgatggtttcaatggtacacctggcaacggaaaggatggtgcttaaggccgttaagctcactccgtacatggggtcaatagcaacccggaaatcccgggagcgtatggcctccatgtcaataacggatatgatattgtcaagatattcgtttagtggattgatttcctctactactccttttttcacaagctgcagataagaggccggggcatttgtcctgcctcctggcggtttggccggtatattttctccgcttctgagagatacgtttcaatatcccgggtctgcgtctcatctgcatcacgccctccataggtaaacaccttgatcccgttataaatggctgggttatggctggccgttaccatcatgccgtagcttaaccggtgcttcatcacataaaacatgatgagaggtgtgggggaactgcggttaatgaaaaataccctgattccctgacttccgaatatttcacaggcccatatgaccgcctccttggacagaaaacgtctgtcatatcctatgacgataccttcttcctcttttttttctgttttcattttaaggctgacggcaagagccagcttttggatgttttcttttgtaaaatcttctccgataatggctctccagccacctgtgccaaatgttaccatcctttgtattcctccttttctgaaaatgcccaaagccttcaaaagaaaactttgggcagattgttgtggcatggatccgcagcgcagctggtaaaaccgtaggttttaccagctcacgggcattcgccctatgaaaaaaggcagaaacagattttttatgtgcgagcacaacgaaaatctgtttctgccttttttcgcactgctcattgctttcgtgaatgttatacaaccgaaaccctccccttgctcaccttcaggaaaatgagaagggatatgacggtgctgacggtcagtatggaggccagtgccgccgctgtgccatagctgtttcggacaacctccgtatagatggctacggatatggtacttgttttgccgccgtaaagcataacgctggaggacagctcattgatgcaggtgatccagcttaagatagctcctgacaggatgccgggggccatgagccttgctgtcaccttgacaaaggtcctcatgggtgacacgcccaggctgatggaggcctcctccacacttgggtccatctgctgcaggaaagcacttcctgaccgcaccgtatagggcagcttcctgactacaaaggctataatcataataacagcagtacctgtaaggatcatgggctgcttattaaaggctacgatcaggctgatgccaagtacggcgccaggaatgacaaaggggaacataataagaagatccatcagctgccctgctatccctttctgacgtatcacaatgtaggatatcagcatgccaagcacgataatgaatacaatggctgtggcagagaatacgaacgtattacggatattagtccacagcctgttaaaaatcgtcacatagctttctatgctgaagccttttttaaagcctgtaaaatcgctttttacaaaactgctgacaaccaccacgatctggggaagaatgccgataaaggtcaccagcataaccggcaaggttaccagaaagcgttttaagccgtgaagctgttcttccttaggcggtctcatggctgtcatgacatagttttttctggttacgaaatatttctgcagcaaaagcaccgttgtggaacagaggaccacaattacggacagggcgctggctaaatgggcatttccgccgatttcactcatatattcgttatataccagcacaggaagaaccatatagccttcaccgatgagcatgggtgtaccaaagtccgcaaggctggtcataaataccatgatggctccggcagcgatggagggaagaatgaccggtatggtaatggtcaaaagcctgcgcagcttgttgcttcccagattctccgccgcttcctcaaggcttgagtcaatgcttcccattgcccctgacgtatataaatacacatagggaaacagcttgaacgtgaagacaagaataatgcccagttttccataaatactgggaaggtggatcccaatgccttcaaaaaactgtgtgacaaagcccgcacgcccgaacagcatgatccagctgtaagcgccgataaagggcgggctcataaggctcataatgatgaatatatggataaaacgttttccaaaaacattgtatctggacatgagataggccatgggaaccctacggccagcgtcgtagccgtggtgacaatggagacaaacaggcttctcccaagggaggaataataatactttttcgtgaaaaaccggatgtagttctcaagggtgaagccttccaccttgccggagaagaagctacgtgtaatcagggtgcagaacggatagatcagaaacagcagcataaaccccactaccgccactttcacccaaaaccagaagtccagcttctttcctttctttaccatgatatcacctcctgggtctgggcatcgtatacacctaccgcactgatatcaaagttcacccgcacctcctgaccgtcaggccgtaagtcgccggcatcctttgtgtattcgtttaattgaatggtcttgccattgtttaactggatctcatactcaatgaaatccccaaggaaggtggaaatgacgatccggccgggaagcccttccttttcatcgaagaacatctgctccggccttgcggaaatgatcccctttcctttgtaggcggatttcagcctgcaggttaaactgcattcgtccttgatgtttaaaacggcgctgtccggatcgcttccctccacctcacagtcaatgaagtttgatactccgatgaatcctgccacaaaggtattttccggctttttgtaaatctcttccggcgatcccacctgcatgatattgccttccttcataactgcgatccggtcggatatagccagagcctcctcctggtcgtgggtgacgtaaatagtggtgatcccaaggcgtctttgcagtttcttgataaccgttctcatctgcactctcagctttgcgtctaagttggataagggctcatccatgagaagcacccccggctcaatgacaaatgcccttgccagagccacccgctgctgctggccgccggacagctcattgggttttctgtcctttaagtttttaatctgcaccaggtctaaggcctcctccaccttgcggccgatctggtcctttggatattttttagctttcaggccgtaggccacattctcagccacggttaaatgaggaaagatggcgtagttctggaacaccatgccaatatccctcttgtgggcctccatattgttgattaccttatcatcaaaacagatctccccgccatccacagaattgaatcctgcgatcatgcgaagcagggtcgtcttgccgcatccggaggggccaagcagtgtgaaaaattcccccggcttcatctctaaatccaccccatttagcgctgtaaaatcaccgtacttcttcacggcctgtttaataataactgcatggctcatacttttcgctcctccttaaccctttggctgtcttcctgcctcttacagcaaaagactgtcctgtccccgaagggctgggacagtcttttttgtcaaaatgtattcctatccttttttaattgaccataatgtcattgaatctctcaataatggtttctttctcatttgccgcccagtcaaaatcataatccaccagtacgatatcctgcagcttcgccaatccttcgcctacttccatgtcgcttcttaccggacggcggccccagttcttgctctgctccgtctggcattcctttgacgtaacgaaatcgataaacagctttgcgttctcctcgttggggccgccctttacaagagccacaccatccggcactgcactggttccgtctttgggatatacgaatccaaccgaaggatcctccttatactgaactgcggatttctccaaagtcagacctacgtagaattccccgtctgcaaccatcttgtggcattttccggaagagtctacgatcttgccgtccaggttgtcatataatttcttaataaaatcccatcctgcttctttgccgccatggcccaggatcatggtgcacagctgggtgtaggcagagccggacttggaaggcaggcagtatgcgatcttgcctttccattcaggctttgttaaatcctcccatgtctcaggaatggtaaggccagccttctcaatcaaatctttgttgtaaaagatgaccatgggcagagggctttccccgatccacatgtcatcagcatccttataagcttcacctataaattcgtcgttggcacatacatagggagcgaaataatccttaaacgctgccagtgaatcagcaccgccgccccataatacgtctgcaatgggatttgcggactcggctgcaatacggttgcacagctctcctgtaccggctgccactacttccaccttaacatttgggtacttctccatgaataagttcacgcctgcatttagggggtccgcatcatggggagaatagaccacaactgttcctttgtaatcctccggagcctttgctgccgcttcccctccggcctttgattcctctgcctttgtttcagcaggagctgcggtctccgcagaagtctggggagctgccgtggtttccgcaggctttccgccgccgctgcaggcggataagcttaatgctgccagtgctgccagtgaagctgttaataatctttttttcatatataacctctcctttataaaattatttgtgttcaccaatatataggaatgttttaattccgatggtctaattatatgattctgatgtgcatttttccatttaatattcttacatttcttttgtcattctgaacttttgcactatttttcatttatttccccgtcatacatgtacataattcataatttccaataaataagtgccttcggcacctcaactcccctagcccctcattcatgaggggaattaggggattcctttttacaacttttcctttataatagtattatgaatgtcctacaaaagatttttactgaccattatgaagaaatgctatatattcttcatcctcgtgacattgtcacagagaatgttgaaaaaatgattcactgtggggatccttctttcggcggcgccttgtatggatgccctttttgtggtgagcttaagtttcttcctttccgttgccattccaagttttgccctacctgcagcaacagatattgtattgaacgctcaacaaaaatggcctttaagctcatccgctgcacccaccgacactgtgtttttaccattgatgaagatctacgccccttcttcctcgaagaccgtactctactggattgtcttttccacgcagttcgcagtgtcattctcagaatgtttctctcaataaataaaagtagaaactttgttcctggtttcatctgtgttctccacaccttcggccgacctcttgagtggaacccccatatccactgccttctttcagagggcgggttctctgacgatggcttttggcgcattgtgaagcatttcaactacacctatttaagaatggctttccaaaccgctcttctaaatgaaatggaaaaacgcatcggtccctctttcaaaaaaacaaaagctgccatttattataaagacaaaaatggattctacgtttatgcaaagcctaatctatgcgattctgataccgtagtgaaatatatcagccgttatctcggacgccctgtcattgccacttccaggattgattcctacgatggcacaaatgtggcctttcattacaataagcacgaggataactcttttgttatgaaaacaatgcccgtgctggatttcatgaagcttcttatccagcacataccagaaaagcattttaaaatgatccgatactatggcctttatgcaaggcaccgtgaggtagataagttactttttagagctgtgccaaaatcaaagcacaagaccctcttagacttcaatcggtggcgcactctttttctcttatctttcggatatgaccccttgcaatgcccaaaatgtaagcatgacatggcttttttagaactctaccataaccacaaacgggtccctctaattgaactttatgaaaggacaatggcaaaacatcgttgccgctccagtggtaattctgcttgattttctatcccatctgtttcatactagaagtatccaaagatgggaggtgcttcaatggatccaaatcaattagaggaactcaggcaaaaatatatcaaaaatcctccggaaggcatgactgcaaagctagtaaaaggtatgaccgattctgacctgcttgacatgcattatttccttattgaggatgatgaccttgatgatgacgaatttgaagaaggtttttatatcttctaactcagcatcgtctgttacctatgccctgctctcgcagggctatttgtttacataaataagaatttgagaggaatttcctattatataagaaagaatcccgcaagcgggattctccgcctgcggcgggtcgcccaggcgacatccaaccctgccgccgcagtgcgatcctcccggagggtttttatcgtataggaggaacttccctatacgataaaaaagccgccaaaaatggcggcctgtctttatatttctttaactgaatattcaaattccagatctttgatcccgttccctgtaaacagagtcaataccggatcgtcacatagttccttaataatcggtatcaactcttccctcgttccaaaggatatgttcttgatcccgtttataccgttggggtgtataaagttctcaggtttcggatcaatgttaaaataggtcataagaaaaggaagctgcatctcatgaggaaacaggcacgtaaaccgtaattttcttcccttggtatcattcctccgtgagggcatttcaaaatatccctgattgtatttttccagaatacccttctcttcccttaaatcggtcttatagttctcaagtgcgactccgcaggggcctcctttatggttatcccaataatccaggcggtcggccaatctgctttttccaaacatgcgcaaaattctcttcatgaatttcggcattccagttgaagcaagcagttccagataaggcccttgggaaaaataaataattgcattgtatgggtttttctctgtcccatattccacttcaaatcccttttctttaaattcttctactgcctggtacaagtcatctactttataaataatatggctggttttcacctggattcactcctcctatctgttttggagcaattgttaacctgattgtttattccgaaaaacgcagatggatgaatttcatcatattgatctggtccgatattttcatcataaagcggataccaaagctccactgcctgttaaccggtatgcccttaaagtatttttcacaggcaatggcctggatatccggggaccagttttccagatcttttaaaccattgatgtaaaaatgcatcatggcgcctttattcccggtcttttccaccatacggtttgacttcttaaccgcctgccttgatcccgcatcaaaataaatttcccctccgggaaaacggtgagccatagcttcaaagaccgctttcagctgctcttccttgaaataataaaaaactccggccgaaacaaataatatgccatccccatgattaaaaataacatcatcaaaccaggaagtgtcaaacagggattttgcaatgcttgtgttacggggggaatcgggaaggaacttctgacggaaggcaatcgcatcaggcagatcaagattataccagttgatcgttccattatccaccctggaaaaggtggtatccagccctgccccgatatttacgatggaagcacggggatgttttcggatgaatttgcggatggcatcatcaattttccgggcacggacaatataacagattccgccgaactcaccgaaggttttggcaatggagctgaagtcataatcgcagcttttgatgatttcaatggcttccttatcatttagtatttccagatttttcgcactggccgtggcgcggccccacagcggtaaaagcatggtgttttgcactgtttgggaatttaattccgatttcattttgtatgcttcctcctttttcccttaaacgctccagcccatgctttcctgctggatccggtacagtctttcataaagccccttgttgttcatcaattcctcatgagttccctcttcggacagtctgccctcctcaagcacaatgattttatccgctccggacacggttcttaagcggtgagcaatgacaatgactgtcttgccttcaatcagcctggaaattgcctgctgaatcagagcttcattctcggggtcaagggatgcggtggcctcatctaaaagaacgatgggtgcatttttcaatagcgcccgggcaatggagatccgctgccgttcgcctccggaaagagtgcttccgttttccccaagcatggtctgatatccgtcgggcaaaacatttataaacccatcacagcaggcggcccttgctgcttccatgacttcttcctccgttgcttccatgtttccaatgcggatattgttgtagactgtgtcattaaacagcaccacatcctgaaatacaaaggacatatagctcattaagtgttccgggtcaagggttcttacatcaattccgccgatctttacgctgccctgatttacatcccagaaccgggcaatcagtcttgagatggtgctcttcccgcagcccgaaggtcctaccagcgccgtaatgccatcggatggaatggataccgtaagatttttgatcaccatgtcttttttgggattttccccatggtagccgaaagaaacgttttcaaagtcaatattccagtgcgtcaggggtttctccgatcctccctccatgacaggaacagtcatgagcgtgcgcatccgtttcgtagcgatacggtggtaaaacagctccggcaaaagagtgaactccacaaggaccggtccgtaaatcctgacaacaatgacaaaaaacatcagcatggggatcagctggatgctgccgcccgtcagtaaataagtcccggtgaaaacagtaagacccacacctgcctgtaagatcatctgggcgccggtgacaaaaatcccggtgccgaattccattttgatcgccattttcatcattagatgcagggcattatccagcgccgcaaactttgagccatccaacccgcaggccttgatgaccttgattccttccagatattcctgcacatgatcggaggctttcagctttgcctccacctgcttctcacttaaacgggcctggatctttttgctgccaaggatgaccagaagcgcagcaggcacagtaataaatacggagagagccatcctccagtcaaaagcagccatcataatgcagataatggtaatggaaatggcattggcgcttatctggggaaggatgtggcttagcacatgctctgttgtggaacagtcagccataatgtttgtggtcagttcagaaagatcctttgagttgaaaaagctcatgggcagcttcctgatccgctcggcaatgctgatccttgaattctccgcttccagataagaagtgacgtaagtctttttataatcgtttttgctggcaagaaacaccaggattgccgaaacaataccgcagccaaacaaaaaccacatcctggtccaggaaatctcctgtgccatcaacggctttaaaagctctgcaaaaacctgaatagtaactgcaaagggcagcatgagcgccagattggtgatcgtgcaggcggcaacggctttctttaaatccgtatagcctttatcggtaagcatcaatacttccttccaattaaacatgttctcttatcccctttctgtccatcttccagtcaagagccttcgtatacacgttccacatatcaaaatatttcccctgtttctccagcaattcttcatgacggccctgctcaataagccgccccttgtctatcactataattttattggcactgcggatggttgataagcggtgggcgatcatgattaccgtcttcccatgcatgagcttttgaaatgcctgctgaattaaatgttcattctccggatctgaaaatgcagttgcctcatccagaagtacaatgggtgcgtcttttacaatagctctggctattgcaatccgctgctgctcacctcctgaaagatggataccttttgtgcctatgactgtatggtatttttccggcagtttttcaatgaattcatggcactgcgcagccctggctgcagcgatcacctgctcgtcggttgcgttctggtttcccagcctgatattatccataatgctttgcttaaagaggaacacatcctggaatacaaagctgaccttttccattaagtattcgcttcgcatctggcgcacatcaacgcctccgatgaggatcctgccctccgtcacatcgaaaaaccggggaatgagatgggcaatggtgcttttgccccctcccgacgggcccacaatggcagtaatctggttttcctcagcccggaaggaaatgccggaaagcgcctgtgcctcctgaccggcgtaagagaaggatacgttttcaaatacgatttcatggctggagattttcctgggattctgtggctgagacagctgcggggtctgcaggatctcatccattcgttccactcctcctatgatctgcattccgctggtggaaacgtacatgattttcatcagaaccgctgcaatggatggaacaaaaataagataaaaaataaatgtggcagcaaagtcagaataatcagaggtatttaatccgatcaggatgcccacgggaatcaggaataagtaaatgttattgataatcgtgtgaaaggacgacatgtagttttcccagctaagggtatagggaatgaccatgcgggtgtattccttgatggcgctgtgcatccggcggaaggaatagaccgtttgcttaaaggccttgacaacggtgattcccctgatatattccacggaagcattgttcatatcctccagggcggtctggtacttttccatcatggttttcgccccgtcattgccataggctttcatctggatcacaagggcaatgactattcccgccgcagcggcaaggccaaaacgccagtcaacggccaggagaataataaacatgaccacaggagccacaaaggaggccaccaggtcaggcagctggtgggcgataaagccttcgatcttctcaatgttttcatccatgatctttcgcagcttcccgctgcccaccagcatatgaaaccccagaggcagtccggccagatgggaggcaaaattcaccttcagctcatacaaggtgccgaaagccgccagatgagaacacatcaaagccgcaaagtacagcaatatattgaggatgattccccaaaagccagccagccaaatccaatggtcttttgcagatcaagattcccaaaatcagggaatacccccatgacttcccgaaccacaaagtatatggcgatataagggataaacgaggcgacagatgccaaagccgacaggatcaccgaagagaccatgagaggctttttagttgccgcaagctccatcagcctggccatacctgttttaggcttagctgctgcagaattagtttgtttcataacgaaccacctttcttttaaaatgtactgtttttcataccggctcccaatggtctgtaacaggcaaaagaaatgccattccagataaccgccccggccattccacggcggcctggattttcagggatttctccctgccgcagaaacgattcatgcttatgtagttagtttaggctaaccctcatataaaacttctttgctcaaagccccatgatcttcttccagccagcatgctggaacctcccaagcacaagggaataggaaagagccttttccctgggaacatcatgggccacaaattccaggatctgctggaaaaatgaacgggacaaaatatggatcagagtgctgtcaatatccatgacctcatgacctaattccttcatggcctcgataaaatcccagctggacttctcttcgatctgagcgagctgggcaaaataactgtcacagcttcccgcagtccctttacaaaataacagcttaaagacgtcaagcctgtcataaatgtaactgatcatccatggaatcgtatcatcggtaatattctccagggaagctgcctgatcaatgggaggaaggcttgcaaattcttcatgaacctgtctgtacctttccaaaagtccatcggccgcatcacctgtcaaggcgtcaaacagcgcttccttactgggaaaatacccgtaaatggctcctgttgtcacagaagcctcccttgcaatccttcttagagacgccccttcatagccatattccataaactctttctttcccgcctccaaaatagccagacgcgtatcgtttatctgagcgctcattctatctcctttttataacactgttatataacaatgctattatggaatgaaaaaggcaggacgtcaagacgccctgccggttatttttctcattaagccgtttgaaaatgactgttgataatttttctcatagtctgtttcctaaacctggccgccttccacaaccagattttccggatcaatttcatctccgtacacaggctttaaagtttcctcaaaatccttgtggaagaactcttccttgccaagagtttcgatctcactgttgatccagtctaaaagctctttgtttcctttctgaacagccggtgcaatggtatccagatttccgatggattcgattcctacggtaaatcccttgttctgaatggcccaggcaagaacctctgtgttatcggtggagaaagcttctcctcttccgtccagaagtgcgtcataggcttcctgatactcatcaaactttaacagcttgacttccggatggttttcagagaaataggtttccgccgtagttccctttaccacaatcagggtcttatcctttaattgtgccacatcactgatcaaagcggcatcaggagataccacgccaagagccaccttcatgtaaggaagggcaaaatctacctgctcttttctctcatctgtcacggtaaaattagccaggatcacatccaccttggcggactttaaatattccacccggctggcagcctctacgtatacgaattctaccttatcttcacttcccaataagtcctttgccatgcgctttgcaaaatacacatcatagccctggatttttccgttggaatccacatatccaaatggattcttatcgctgaatacgccgattttaatggttccggcttccttgatctcagacagggttctcgcctttgcagaggccccgccagctgctcctccgttatcctttgcctgaccgcagccagccagaagacctgctgccatggtaatgcccaataacgctcccagtaatttcttgttcataattgtatcctccatataattttttattttataacgcttcataatgaaacgtatttaaaaactgctttgcccggtccgtacttggagaggtaaaaaactcttccggccggctctcttccaccaccacaccatggtccatgaacaggacacggtcagccaccgccctggcaaactccatttcatgggtgacgatgaccatggtcattccgtcctttgccagttccagcaccacctgtaaaacctcccgtaccatctccggatccagggccgctgtaatctcatctaaaagcagaatctccggatgcatgataagcgcccgtacaatggcaaccctctgcttctgtcctccggacagctgcctggggtatgaatcctttttatctaaaagtcctaccctggccagaagctgttgcgcttcctccgtcacttcttttttatccctcttctgcacttttaacggagccagaaggatattccctaaaatagtcttatgagggaacagatcatagctttggaataccatgccgatcttctgccttatttcataaacatcccgcttggttctgtcaatgacctggtccttaaaccggatcgtgccggagtcaatgggttccagcatgttgagacatcgtaaaaaagtgctttttccgcagcccgaaggcccaaccaccaccacgacctctcctttttgcaaggtaaaggaaatatcctttaaaaccggctgcccgctttcataggacttcctgaggttctctgtctttaaaatcttttcctgattcatttttctcaatcctttattttttatctagcagggcagcggccctggaaaacgggtaacagatggcaaagtacaggataaagatcaccccgtatacccagagcgctgcatcaggaaccgtgtacctggaagcgtcaatgacctgttttcccaccttcaccacctcgatcacgccgatcaatacaacaagggatgtggttttgatcattctggtcagaagattcatgaccgacggcagcagccttcttatggtttggggaatcacaatataccggtatactgcaagctctgtcaggcctaaacctaagccgctttgatactgatgaaccggtatggattccagagcacttcgcaccagatcccccatttcagccgtcccccaaaaggtgaatacaatgaccgcagccatttgcccggagaaattcacgttcaaatgctttgcagccccaaaataaacgagaaacaaaagaaccagctgaggcatgatccggaccgtttccagataaagccttgtgaaaagcttaaccggcttttttttgctggtcatcaccattccaaggactattccaaatcccacggacaaaaccatagacattgctgcaatcctgagagatacccaaagtccgccaagcagccgtaaaaaattatttccctcaaacagtatcctaattcccaaattctgcatagcggactctcctttctatccaggaacagagtaaggatatgggcagcaaaataattaagtatgctgccaccagcattaggagggcctcatctgttttataataaattcctatcagatcctttgccacaaacattaagtcagccagtgccactgcactgaagaccgatgtttcttttatgagaaatatgatgttggcacaaaatacggggactgaggtggtgaccgcctgaggaaggataatatgcaggaatacctgcccctttgtaagtcccaggctgagacccgattctgactggatgaccggtacctgttcaattcccgtgcgaaaggcttccgccatgtagcttcctcctaaaaatgccagccctgtcacggcacagctttcagagcttaaaacaacaccgattttaggaagtccgaagtataaaaagaacagctggatcaaaagaggcgtatttctggacacctcaatatagccattcacaatactctttaacaccggtatgttaaaaatcttcaccaggctgcacaaaagaccaatggctgcagacagcaggattcccagaaaagatattcgaagtgtcatacctgccgcctctatatacagcggcgtataagcacggataaactcaaaatccatgattcttcttttccccctccttttttcttatatgatccatcaattattttcctccctttttgttaatcaatacaaaagaagcaggtatacgcatatacctgcttccttccatttcttttctctttgtcacaagataaaaaaaattggaaatcagaaaccaagacacgcatgcaaataaactgtatctcttctcatgaagcatctacagcaataacacttcatcatatgattcacgttccacttgcagctcgttgtcattttccggatctccttattcatactaaacctatatgtttaatatactgttattttgcccatttgtcaacctttttttgggcttaaacttctacgataaaaatttatgcccagtccctgctaaaaaaaatcacaagaaaaggctaacctgattcagattagccttaatacctgggatcaaacccagctcttagaaaactgtattataatgaaactgacatatcttcgtccacaggcctattatacaaactcacatcaagctctgatgtcatcctagctgttacaaggccagccagcatggcatcattcacattcaaagcggtccgtcccatatcaattaaaggctccactgatattaacagtccggccagacctacaggtaaattcattgcggataaaaccatcaaagcggcaaatgtcgcgccgccgcccacaccggcaatgccaaaggagctgattgtaacgataatagccagttttgcaataaaatcaatactcatagggttaatccctacaacaggggcgatcatgacagccagcatggcgggataaacacctgcacagccattctggccgattgttgttccgaatgatgcggcaaagttggcaattccatcaggaataccaagtttttttgtctgtgtctcaattgttaaaggcagcgtacctgcactggatctggatgtaaacgcaatggtaagggtcgggaatgcctttttaatatatgttatcggattcaatttcatcagcaggataatcaaaagatgtatggcaaacatgacaatcaaagcggcatagtttgcaattacaaacttagacagagcaataatgcctgcggtgttcgttgtcgcgattgtctttgtcataagagccagaatgccatacggcgtcaatctcaggataagagttaccatccgcataattacagcatagagggaattaatgatttttaagaaagtttccgcttcttccggctttttcttttgtattcccaatgcggatatgcctaaaaacgcggaaaagatgaccacggctatggtagaggtagccctgctgccggtcatatcctggaaaggattctgggggataaagcttaaaatctgctgtggaatcgtctgctcctgtacggttgtaacttttccttccagatactcagccctgtctgattctgcctgacccacagttatttcttctgccgacagatgaaaaatattggcggtcgcagtgccgaccaaagcagaaatgaacacagtcagcagcaatgttgccagcacataggtactgatttttcccaggctggtatgggattttaaattaaccgtggccgatataatggagaccattataaggggaataacgatcattttcaaaagattcacatagcccgtaccgataacggatatccaatccagtgaagttgcaagtatggggctgtcagatgcaaaagcaagctgcagtatactgcccgctgcaattcccataagcagggcagaaaatactctctttgaaaatgatatgtgtttcttctgcatatggtatagaataccgacaagcatgagtataacggctattgtgaccaaagtccatactaaatccataaatatcctccttgataaccatacatattgagcgctgcaatatgagaaatttgttaacggggaatgactgtgaatctgctgaaaccttccatggtgcattgattctgatccggctttggaaaaagtatattcacaaagaacaaccttaatgatactgtttttaaaagagctgttaagcagatcaataaaaccctcagaatacttctgtctgattccaactgatgccgatctatataacatatatgtttagtatgttaacattatgtggtaaatttgtcaattttttcacctgaggatgtttatcagctttgcagtactacaatacatttgctgcagccgaataatgaaaaagagggaaacaccttttctgtgttatattttaatctccagaccaaaatataaacaaaaatcaggtatttccctctttgtcatcccaaccagcataatgatgccgctggccaccttaagacggattctgtttttcttccttcatgatgcgtacaaacaactgggcaattgccggatcatactttttcccggagccccttaaaatagcctgcagcgctttttccgctccaactttcggatccttttcccggttaaagttcctctcataagcttccgcaacagataatatccgtgaaataagggggatctcctctccctttaagcccttgggatatccggaaccatcccagcattcatgatggccgtacactccgttggcaagatccagggtttcctgggacagattcagtatacggtatccgatggcaggatgctgccttatcatttcatgttcaacttctgtcagctgatcaggagttttctcaagaatcgattcgcttagggtgatcttgccgatgtcgtgaagatacgccccatccctcagcttcttaagctctgtttcaggaagccccatggcaataccgatcttctcgcacagcttgctgacctcttccgagtggattttctcccacgggcttttcatatgaagagaggtgatgatgccgttgatggcatgaatgccaaagtttatggaagaaatgctcttttccttatacatttcattttctgctgtctccagtatccgttcgatcttctgccagtgcttgaactttgttgcagttcccactgcaacgctgcatgacaccatattcaccttttccacggcaacctgattttttatccctgcagcaatggtctccgcctcttccctggaagtgcggggcagcaaaaccgtaaattcatcgccgccgatgcgggcagcaacatccccttcccggcagatctgttttaagaccccggcgactttaataataaattcatccccggccgtatgtccaaaggcatcattgatgagctttaagccgtttaaatcaagaaaaatcagagagaccggatggttctgctgcgtatccacctgtttcatctcctgttcaaagcaccttctgtttaccaatccggtaaggggatcgtgatagcttaaaaagcggatcttttcctccccttttttccgttccgtgatatcggcaactgttatgacgtacccgacgtgctgcccctcctttaactggggcagggcccgatactccgcctcaaaatacgtaccgtccgcccgtttaagcgcaccggcccaatcttcctgcccgccgcagcccagagcagcccccatatccctccccagcagctcctcgggctttgaatatcccaggaggttaagacagcttttgttgcagaacgtgcatcttccatttaagtccgtaccaaatatggcttccgccgcagtatccagtatgaggtgaagctgggactgattctcttttaatatttcatttgccttattaagctcctgggtccgcatttcaacaatacattctaaatgcttgaccatgtcaaggagactgtctgccagccggttgaatacgttggatattcttccgatctcatcgttccttacaatctccactctttgctctaaatttcccgcggaaatgccttccgcaacagtaagcagaccgttgatgggcttataaagccttcggatgatcagggaaaagatccctatggaaagaatgccggcagcaacagccagctctgccgataccctgatattccggttcagttccgcagccaggaggctttccgggatcgcggaaacaataatccagtttagtccggccttgcggtactcctgtatgtccgcataccagttgtcctttcctgtctttaagggaaattctgcctcatgggatttaagatatttctcatagctgtcttttataacgggaagagaaaggccgtcaatggtatttcttttcagtgacccatcggcggctatggcataattatcttccccatggaattagcgattaaataccgggtatcttcctccagcacagacacacagcccttggaaccggccgcctgattttttaaataattcccaatgtcagagagccgcatgtgagctcccaaaacacctttcagtcttccttcctcatcatacaccggacatgaaacggatactgccaggtcatccaccagaaaatctctgtatacaggggaaaagacaggccctttctctctttcagccgcctgataccattccagcagccgcggatcaaaggctcctaaattcagcataaactcccctgctgtaaaattctcattaacggagtaacgccagcattctttccctgtttcatcattgttctttacgagttcaaattcccctttttatttctgagggcaccataatactccccatcaacccctgcataagcaaaactgtaaatctcattctcataggattttaaaattccaagaaaaaaagagttgcggctcttttcataaaaaaaatcaatggttttattttcaatcagttttttccctatttcatttgccgtaaccggaacccggaaaaatgaatttaccttttccatcatatcctggttcatcttttcagacattccggcggtttctctggttattgaggattgccaattgtttaacacgagtttttctatacccacaagggataaaaggaacagacagataaatgtgactatggtcacagtttgaatcgacatgctttttcgtggtcttcgtaatctcatcttcctgatcgctttggttaaacataccctttcctgcatggctcattccctttattccaggctggccccgcatgaactaagtataactatttcttttataaagttcaaccagaaaatatccgcaaataaaagaatccaaatccgctgtaatttcttacaacaggatttggatttttcccacgcaatttattaatatgtaaacagctgtacccagtactgagttccggaaccgtcctgagtattgcctactccgatatgtgtatagctcttattcatgatgtttgcacggtgtcccgcactgttcatccaggcatttaccacttcctgaggagttttctgtccccatgcaatgttctctcctgcaccgcggtaatttacaccctgctcttttaaagcagttgagaatgagcttccgtttggacgtgtatgatcaaaatttgactgtatttctttggctcttactgatgcagccttctctacattaggatcaatggtcagaggggaaagtccttcttttgctctctccgcatttacaaggtcaactacctgctgggtataagacttattggaggtggaatcatccggcgtggttgtgtcattgccggtgctgccatcgtttccggtatttccattatttccattatttccggtattgccgttgttaccgttatttccagtattgccgctgtttccattatttccggtattgccgttatttccattattgcagttactgccattattgctgccattgataagcttagaccagtccacattgtttccgtcaactccgtattgctgcagcttagactttaaatcatctaaattacaattcctgctcactgtcacaatgtttcttccggtgttgcactgactatagggtcttgccactgctgcatttgctgtcaatggtatcatactcgttaaagttagtgtaatcattccaagtgccgttagttttctcaattcatttgcctcctttgaaattgttacatttatgttacatttatgttacaaacatatgataacactcttgcttccatttttccagtggaaataattgggaatcttttggatggaaatgaaaaagcggcggaggatgtcctccgcccttttgccagtgcagttttaccaattttcattttatatgatgtaatcatccgaatagccgcttttagacattaaatcagctatggttattccgtcaaaataatcattgatcagcttatttaaaccttcccacatggcaagagtctgacaacgggaggctcttttgcagtcattggtttccccttccagacaggaaacgggagcaagaggcccttccgtgagccttaatatggtgccgacagtataatcctccggtttcctcgccagcttgtaaccgccgccctttcccctcagggaaatgagcaggccgctcttactcagaaccgaaacaatggattccagatatttttccgatatttcctgcctctttgcaatatccataagagaaacatattccccatgattatgttccgctaagtctatcatgagcctgagcgcatagcggccttttgttgaaatcttcataaaatacagcctccagatctgttattatgtgtccatatcataaccgtcaaggaagtggtgtacctttccgttttccttataggcgattatggtatttaaatttacattttccacgctcttaaaaatattgctttcaatatatgggttgatctcctttaactgtctgatcaggttcttgatctccacccgctttgagcctgtgctgccgtctgttctgcaggtagtacaggtatcggtaaaccggcaggcacactggataaagtgcaggccgttgtagtccctccagcctttaatatcatcttcccgtataagatacatggggcggatcagctccatgccttcaaagttggtgctgtgcagcttgggcatcatggtctggatctgcgctccgtacatcatccccattaaaatggtctcaatgacgtcgtcataatgatgtcccagggcgatcttattgcaccccagctcctttgccttattgtacaaatatccccgcctcatcctggcgcataagtagcatggggacttttccacatcataaaccgcgtcaaagatctgggtctcaaatacggtgatgggaatattcagaagccttgcattgttttcgatcacctgccggttggtttcattataacccgggtccatgacaagaaaaaccagctcaaaaggaaatttgttgtgacgtcttagctcctgaaacagtttagccatgagcatggaatccttgccccctgaaatacagacagcaatcctgtcgttttcctttaccagctcatactcattgatggcctttgcaaacctgctgaacagctccttgtggaattttttcctgatgctcttttctatgttttcaaggcggtcgtctgacttatcctctttttccatggcacgaagcagccattccccataaccgccccggagattatacgcttcataacccttttcccttaagtctcttgccgcatcttcactgataatcccttttaagcagtacaggatgatcttcttatccctgggaagagggctgtccccgtttaataatgcctctttttcaatatttatggctcccggtataaaaccatggttgtatgacgtctgatccctcacatctataagtacatactcctccgggctcatttgcttcatttgttccaatgacagatcctgttcctgagacataccgccatcaaacatatgatcacctcttactccattcatttccgtctaatccttccgtgccaggtccttgatcacttctccggctatgataagccctgccactgaaggcacaaaagcaacgcttcccggaatatctcttcgttccgtacacttatgcttggctccgggcgggcagatacagtttgtcctgcagctgatggacatgtcttccaaaggtctcgtgggcttttccgtggagtaaaccaccttaagcttttttacgcccctcttctttaactctctccgcattacctttgcaaggggacacatggtggtcttataaatgtcagccactaaaaacttcgtaggatccagtttattgcctgcgcccatgcagctgatgaccggcacccctgcttcttttgcgcgcatgatcagctccagctttgcggttacggtatccaccgcatccaccacataatcatactccttaaaatcaaaatcatccgcattttccggcaaatagaaacattgatggatttccacctgtgcgtcgggattgatctccaatatcctgtccttcattacttccactttatatttgcctaccgtttttctggtggcaatgagctgcctgtttaaattagtaaggcaaactttgtcatcatcaacaaggacaaaggaacggaccccgcttctcaccaaagcctctaccacatatccgccgacgccgccgataccaaaaacagcaacctttgcacccattattttttccatggcatcttcacccaataagagctgggttcttgaaaactggtttaacaatcgattctacctctttctttatttttctatctattcagtaggaataaaatacacttcaaattattatacttcgaaatgtttatttgggcaattaatttttactcttaaaagaagaaaagccccaggatcagggacttttcttccttactttaccagccggtacaaaccgctttcttctttttccattcttgctacaatgcttctcatgattttttcaacttccccgaaaaaactatccctttctgaaaggattttaattttcgtattatatttatccttaaattctgtaaacagggcaagcagattccccatttccctttgatattcttccgcctggttcaccagctttgaatcagcggatcttaataaggccgggtaaagatactgatcctctgaggataaatgtattttcagttttccggcaagactgcttatatgtaaggcgatttccgatgccgtttgttctaagtccctgtttttgcacagcgttttcaagatctctaattcttcccggatccggtcatgctgctccatataatttttcaattccattcctgtacacgcctttcttttgtatcgtccaaacagcagccgggacggcctgtttccccttcaggccgtcccgtccttgttaccttgttttttcgcggatccaggattcgtacttgtcctgtacgccctgatcctttgcttgaatttcaaatgattccgtctcatcatccacagcttttaacttatcctgcgccagcgcacgtactgcaaacgcataagcggcctcatcttctttttcaatatggcgctttaataatgcgccgtagcccaccgcattggagataatatccaacttcggctctgttcccggatttctctcgtattcatcaatggccgcttccagttcagaaaggtacagtcttcccaagtcatgttccacaagcatgccgtttcttataagcttttccgcaacaggtcccatgttctccatcatgatccggaacaggatcttttcttcctttccgtgatgatgcttgtctgcgtaattccttgcaaaatcaaggcattcccgcagcagaggcgcatccaccggcttcccttccaggatgtcggcgctgatgcttcttaaaaatccggtaaaagccagaatattttcatgctctttcattaaaatgtctattccatacataagcgtctcctcaattcgtatacctgatcctcgatctggtggaattctatcccggtttcttcaaacatcccttctatcagagcttctcttaaggcataataatgtgctacgtctccatggatcatcgcccaataagcgccatggatatcctgtgtctgtttccataccagcttgtcttctgtttcctgaaccagctcatttaccctgtcgcagggcattccgtttaacagagtgctttccagataatcataggctttccgtactgtcatatttctatccgcagaatttctctttccaaattcccggacagcaaaaaccaattcagacagtctctcctgatcctcatttaaaagctcagtgaccgcataagccatccggttttccaccaggctcaccttttcctgcagccagccatggatattgcccgtgtcaatcatatcttctaagtttcccttttcaaggacaccatatctgcttccggtcttgcttctaagctctttaccgtatcccttttcttccgccagatccaggatcccatcaaccattgcatcctggaattttattttattgtataaccatgtgtggattggtcctaaaaaagcgctcatcctgtacctctttccttctttattgattcagcttgtccagaactgcgtctgcatcaagcccgtgaaccatacacgcatcctccagggattccatctgggatgaaggacagcccagacagtgcatgccgcagcccattaaaatctccgctgcttctgggttgcttcttaaaatttcgccaatatacatttctttcgttatcatataattttcctcctgatttatgattcattatttatattatccaagaattttctttaaatcctcttccggtgtgctgatggatgatattccatagttttcaacaaggaatgttaatacattcggtgataagaacgcaggtaaggatggtcccaggtaaatattcttgattccaagatgcagcaaggtaagaagaatacaaacagccttctgctcataccaggacaataccatggacaagggaagctcattgacaccgcattcaaaggcttctgccaatgccaccgccaccttaatagcgctgaatgcatcgttgcactggcccatatccatgattcttggaagcccttcgatggttccaaggtcaagatcattaaaacggaattttccgcaggccagggtaaggataatggaatcctttggtgtctgctttacaaattcggtataataatttcttcctgtcctggcgccgtcacagccgcccactaagaaaaagtggctgatggctccctgcttcactgcgtcaatgacctgatccgcaactcccagtacggtcccatgggaaaatcctgtcatgacttccttgccgccgttgattcccgtcatttcgtgatcttccccgtatccgccaagctccagggccttttcaatgacaggggcaaagtctttgtcctctccaatgtggaccatctccggataggaaaccacttctgttgtaaatacccggtctgcatagcttttctttacaggcatcagacagtttgtggtaaagaggattggggcaggaagttcatcaaactctttttgctgattctgccaggcggttccgaaattcccctttaaatgagagtacttctttaattccggatatccatgggctgggagcatctctccgtgagtgtagatattaatccctttctcctttgtctgctcaaggagctgctttaaatcatataaatcatgtcctgtaatgacaataaaggggcctttttcaatggtaaggggtacggtggttggcttcggcgttccaaaagctgtggtgtttgccttatccagcagttccatgcactttaaattgatctctcccacttcaagggccaccggaagcagctgctccatggacaggtcatagctgataatggacagggccttataaaagaattcattgacagcctcatcctcgtatcccagaaccatggcatgataagcataagccgcaacgccccgcagtccgaataaaatcagggactttaaggaacggatatcttcgtctgtatcccagatttccttcatatcatactctgaagtgtttccgcagacagaggtgcatttgctgcagtccggcacgatcttttccctttcttcccgtaccctttcgatcatctttattaaaacttcatcattaaaatttacgtttgtaatggtggtaaacagcccttccacaaggattcttgtggtagtctccaaacggggattatgaccgcaggcctttgcaagaccaataagagcgcctgtcagttcatcctgtaaatttgcggtacttgccgacttgccgcatactcctgcgctgcccgtgcagccgctgcatcctgctgtctgttcacactgaaagcaaaacatcttactgtccatgttgttattcaacctttctattcttccgttttctttttgccgggttaaaataccaccacaagtgccatcttaaaccgttcttccccataaactgcatgaggctttttagccggcatgataagggtctctcctgcatttaagagatattcctttccatctaccgtgaattttccggtcccttccaaaacagtcaccatggcatctccgttggattcgtgggtgctgatctcctcccctttatcaaaggcaaacagcgtaatgctgagagcttcattctgtgcaagggttttgctgacgatctggccttcttctgcgtgaaccagatcagccaatactacgatctcttcatgatttatatttttaatgagtttttctgacatttgacttcctccttgtttttctcttgcttttataagcagattataatataataattacatcatttctgttgtaattacaacaaaacaaaaataaattaaaaggagagaggaaatggaggaatttctgcccgtattaaaaaaatccaacctgttttccggagtcagctcagaggaaataaacgccatgttaaaatgtctgtcggcacggctcaagcattataaaaaagaagagttcatcataagaagcggagactatatccgttctgttggaatgatgctctctgggaccgcactcattatacaggaagatttctgggggaaacggaccattatttccgaggttctgcccggcaccatatttgcggaaacctatgcctgcatccccactctccccattgaaatgagcgtcatctcagattccgaatgtgatgtgctgtttctggactttaacaagatcctgcacgtgtgcacctcttcctgtaccttccacacacggctgatacaaaactttttatcctccattgcaagaaggaacatggttctcacaaaaaaaatgcagcacatgtccaaaaagaccatccgggaaaagctcctctcctacctttccgccgaatccttaaaaagcaattcctccacctttgatatcccctttaacaggcagcagctggcggattacctgtccattgaccgcagcgccctgtccaatgagctgagcaaattacaggaggaaggcatcttaacttataaaaagaaccggttcacattaaaagaaaacttccaccaaggataatcatttataaatgttttccgaattacaggatgtgattttccataataaaacagcggaatccggcatgatcatctgccggattccgttgttttattcataaaatgttcccatccacagagatagtaacaacctcacatggaatttcttttccgctgtcctcaagggctcttaaagccgcatgttccaatccgccgcagcacggtacctccatccggactaccgtaatgctttgtatggcgttgctcttaatgatttccgtcagcttttcactgtagtctacctgatccagctttggacatcctactagaacgatctttccctgcaggaatttcccatggaaatctccgtaagcataggcgctgcagtccgctgcgatgagtaaatctgcctggtcaaaataaggtgccttcacaggaaccagcttgatctgtaccggccactgtcttaactgggacttaacaggcgcttcagctgtcttttttgtttcggccatacgttcaatttccatgacccggcttcccggacagccgccaagggcaacgtgtccttttgctctggccttcttcttattctgttccactgcctcttcatcataagcgtcagcctcacgctctacgaatgtgatggctccagtcggacatgtgggaagacaatcccctaatccatcgcagtagtcgtctctgagaagctctgcttttccattgaccattccgattgccccctcatggcatgctgctgcacaaagaccgcatccattacaagtttctttatctatctgaataattctacgaatcatttttaataccctcctccaatttgctttctggagccatcatactatgaccgtgggattctgtctgttgtaattacaacaaaattttttaaaaatgtttacctcatggtttttcacatatactacccttcataggaggtattccatgtttccagataaaatttattacgaacctgaatcccttgaatatgagctgggccgctatttaaaagaaaaatacagcgatcttccatggattcccattgaaagccacaacaaaatagacgaactgcgcacccgccccaacaaagatttttccgccatgaagcggcatctcattatcggcatccgcaaaacacacaactatgtccccaatcacaaggtatcggattttctcgttccttatacctcatccgggtgcaccgccatgtgccactactgctatctggtatgcaactataataaatgcgcctatttaaggctgtttgtaaaccgggaaaagatgctgaaaaaaatcatggatcacggagcccgttttgaaaaggattatacctacgagatcggaagcaacagtgatcttgttcttgaaaataccataaccgggaacctggcatggaccattgagaatttcagcaggagcaaatatggatttctcacatttcccacgaaattcaatcaagttgagcctcttctgggaatcaatcacggcggccgggtcatcatgcggatgagtgtcaacccccagtccatcatcacccgttttgaaccgggcacttccaacttaaatgccagaattactgccttaaacagtatgtgtgatgccggataccgggtgggacttttaatcgctcccatcatcatcaccgaagactggaaagacctttattcccagctgatcaccaccctttcagacaggctttcccaaaaggtgaaaaaacaggctctcattgaaatcatcttcatgacctacagcttcgttcaaaacgccatcaatacggaggcattccctcaggccgacctcctttacaacaaagagctaatgaccggacggggaaaaggaaaatactgttacagggatgatataagaaaagacggagaactgtttttaaggcagcagatcgaagaaaagctgaaagaaatgacgattttatatgtagtataggaaacgccgcaccaatccctccatgctttcataacttgtttcacgttccgggtatatcctgccgggaataccgggaagcttagatccggcatagggagacccagggactggtgccggccgcttctttggcaggatttttctcttgcctgattttcataattgctgcaattctttaaaaaataataagagtatcctattattttttgtcaattcatgtcgaagatataaacgttatacaggggcagaaaaatgactcaaaccagtcttaaaaaagaaaggaggtttctcactcttaccggcataaaaccttactgcataccatgcagtatattttttgacccgcacgctggtaaaattttccaacttctgcgccgggggttcatattttactgattataaaatcaaagggagtataatgcaatatgaagaacatgaaaaagctgaagttcagcaatttaaaacttgctgcaaaaacttccattactacgggaatgatactggcagcaagcctgacattgctgattgcaatctccgcggtacaggcgggcatagcagtttcaaaagcaattaacggggaattttccggatatccgcacagaacggccttatggtacaggccgtaatcaatgatgcttccggaactgccaggaatttacaggattacttaaaccgtgcatataacgacagggaggccatgggcgattggaaaagcacggaccggaagagcaagttatacaatgcacaactaaaggaaatcaattatgcaatcgaaaactatatcttaaattccgcctggtctaccgtgggcaataatcccgatatctacgggatcggtgcattttttgaacctggcaaattcgatcctgctgtaaaggattattccctctatgtggacaagacggctgccgaaaataaaacggctgtatctcttggtgcatacagcgagtattcctcacaggattattaccgtgttgccagggaaacaaaggcttcctatattaccgatccatatacctacgaaggcgttatgatgagtaccattacctaccctattatgaagggggatgaggtgatcggagtgattctggcggatattaatgtatcaaacttttccaagataaaaacttcagacgccaaatatcctaccatgtacgttaatatttacacggaaggaaacaccgtcgcctttgacagcaaatccagcgacaacatcgggaaaaatctggcagagatgatccctgcttcagagtatgaaaaaatcaaggccttacagcaggaaaaaacagatttccatatagatacaaaaagatccgacggcaccatagaaaccagacattattaccccattacctgcggctcacaaacctggtgggcttccagcagtctggaaaggaaggatctcaccaaggatgtgacggaaatcatcgcattgatgatccttcttgcagtccttgccctgatctttattaatgtggttgtcatgactttcttaaaaaagaccctccgtcctattgacggcgttgtttcctctgctgccagcattgcatccggtgatctggatatccagatggaagttaaatccggagatgaaatcgggattttgtcaaaaacctttatggacatggcagaaaacttaaattttatcattcaggatatcagtgatgttctgggagaaatgagcagaggcaactttaaagcaatgaccaaaagcgacgaacggtacacaggcgcataccggtatatcctggatgccatgaggaatatccgccttaccttaagcggaaccctttcagacatcgaccaggcctcgggccaggtttccatcggcgcttcccaggtatccgatgcttcccagtctctcagtcagggagcagccgagcaggcctcttccattgaagagctgtcctcagctattactgaagttacggagagggtgaaggaaaacgcagccaatgctttggaagcaaataccttgtccatggaagcgtgcgaaggcatgctgacaagtgaccagaagatgaaagacatgattctggcaatgaatgagatcgcagacacctccggggaaatcagcaagatcataaaaaccatagacgacattgcattccagaccaatatcctggccctgaatgcggcagtagaagctgcaagagccggttccgccggaaagggctttgcagtcgtagctgatgaagtccgcaatctggctggcaaatctgcggaagctgcccagaacaccaccgttctcattgaaaatgccatctcagccattggaaagggaacaaaaatcgcaggcgaaacagcagaggcgctgcggctcgtggtggaaaaatcaaatatttcttccgtgagagttgcagaaatcgcggaagcctcggccgcccagtctgatgccctgacccagatcaccaccggcattgaccagatatcagccgttgtacagaccacctccgcaacatcggaggaaagtgcggcaacctcggaggagctgtccgcccaggcctttcatttaaaggcccttgtaggaaaatttcagctgatggatatgccttccgccgccagccagccgccggctgcatatgaggctcctgttcaggaagaagctgatcataagtattgatgctccaggagtctcatctcctgcaaaacagctaaaaggctgcggggttttaaactcccgcagccttttcctgtattgccattcctgttttaataaaacggaacatccgaagggccccgccataatacaaatcttctgcattttccagggcattttccagctccatgaccccgttgaccgttgtcataatggagcagatcccaaagtcacagatcttctccgctccttctcccattgctcctaccagagcaacagccggaatgttctttcttttgcatctcattccaataccctgcatcacctttccaaaacaggactgccagtctgtccggccctctcctgtcacaaccagggatacatcttctaaacgggaatcaaaatcgatcagatcaaggaccgtttctatccctgattttaactctgcatggagaaacaccagaagagctgctcccagaccccctgctgccccggaaccaggcatctgatccggatcaattccaaattcccgcaggatcacattccggtaattttccattcccctctccagctcatcgagaacctggggagaacctcccttctgctttccaaaggtataggtggccccgtcctttccgcataagggattattgacgtcacacatggtggtcagcttcacctgatgagccctgggatggaggccggaaatatcgatatgagccacatgctctaagtcctttcccgttccttccagttctcttccttctaaatccaggaattttactcccaaagccctcatgcagcccattccgccgtcattggtggcggaaccgccgattgcaatggaaatgtccgtaaatccccggtccaaagcatcttttatcagttctccggtcccataggttgtggtgttccttgggtcccttaaatttctcgggagcaaaggaagcccggaagccgccgccatttcaaggactgcccgtttctcatccagctttccataataagcgtttacaggctctaaaagcggtccgcagacggtgaccgggatcttttctccctgaatggctgcaatcaccgcatccgtggttccttctcccccgtcggctacagggattccggtgcattccaccttgccgaacacttccgctgcagcctttttaagcagttctatggtctgttcactggagagagtccccttaaacgagtcggatgcaaacagtaatttcatattcaaagtcccccttttaccagtgaattttcattctcttttctcattaatgcaggatcaaagacaggataaagatttccagaattcctgcaatccctaaaatcaacgttgccattgtttgggttttataccctttttccggagtcatggctccaaaattcgttaccacccagaaatacgaatcatttgcatgggagactgtcatagcgccggcgccgatagccatacaggccagagtcaccctgacagggctttctaaacccagcattggaagcagaggagccactatgcctgctgtcgtggtcaaagccacggtagaggaaccctgggcactctttaagatcgctgccaaaaagaatgggaagaaaattcccatggtgcttaatacagaagcatgatccttaatataattcaccatatcagtggaggaaatcaccttgcccagcacgccgccggcagccgttacaaacaagatcggcccaactgtctttagcgtatcattggtaatttcataaaattcctccatcttaccagctcctttcagctgaagaataccgcataaggtacctactgccagagctataataggagttcctaaaaatttaatgacatcagctccaaaacctcccatgttcgccatggctgcaacagatgaaagagccataagaaggattgggacaatgattggagcaagggcgtttaagccgctgggaagtttgccgaattcggctacaagctcctcataggttttttcgacctcacccatatccgcttcatcgtcagaccgtacctttcctccgatgtattttgcgtagaaaaatccggcaatcagagggaagatggaacataaggcgcccattcccataacaagaagaaggttttccccaatgccaagggtagaagctgctgcaatgggacctggtgtgggcggaataaacacgtgggaaatgtagagtcctgaagaaagtcccactgtcatggctacggatgacgcggcagtcctgtttaccagggctttacggatgggatttaaaattacgaacccggaatcgcagaataccgggatggatactacccagcccatcatctccattgcaaggaccggattgtttttcccaacaaggcggatcaccatatcggccagcttaagggctgcgcctgttttctccaatatggttccgatcagtgcaccaaggatgataacgataccgatgctggagaatgtgccggaaaagccggctccgattacatttgcaaggccgcttaccttagttccgtcctctaatgtcttatcaaccagcggtatccctgcaatgagccccagaagcagggaaatactcatgatggcaatgaacgggtggatcttaaacttggaaatggcaacgatcatcaggatgattgccagcacaaaaacaaaaattaatggtaaacctgtcataaaatgaccccctttttaacatttgcaatagtttctgctgtttcataggtgtatcataacaccattgattcaatacttctacaaccgtgagtatcaatatgaccattgatttttgtatcgccgatacaaaactaatgttcttttcttaaaaaagtataaaaagcttccatgaaaaaacggtctgccgaagactccaggggattgatgttaaaaatatctttcaccttattataacggtacaaaagcgtgttcttatgcacaaaaagttcctttgacgctgtcaccagattataatttgtctttatgagaaccccggcaatttccataaatgtctttttaaattcatcgctcagctctttttcataaacattgaacatccattgcagctcatttaccggcacaatggaacggacataatttcccgtatgatcataaaaaaaggccgcagaatcggtatccacattttcctccagccatttgcagtgccggtaagcattgtaatactgggtaaagttctcctgaaaggaaccgatgtaaaatttacaattcttctcctgttcccgaagccattttaaagctgtgcttaaatattccgcaataatgtatttgtaatctgcaaataccttacgtgtctgctccggcatggttttaaatacaaggatatgactgctgtccaggataatgctgatatcctccgtcccgtgccttggactctttttgatcatgtcaagaaacggctccggcctgatgtcattaagccggcacaggatggggatcctgatgatgttttccgaataattgagctgctttgcaacgttccgaagctctcccggatccggatattccacatggatcagaaggtttgtaaaatgctccttccggtttctccttcgcctcagctcttcctgctgcttctcgtatttcagcatggcttcaatggccattttggtgatcagggcaacgggttttatctctcccggatcaccggtgatccctaccactccctcccttctgccgtcaatattaatgaccatattgatcccaggctttacaccgggataatcctcctccgtagaggtgaccaccatgtcttcgcttccggtcacaatataataggctacttcatgaaaggagcccacccgtttcggatccctgctggcaataatgaccccctgctcattcatgatgttgatattgtattctgtatattgtgtaacctgttcaatgaatttttttgccagttctgtttctatcatctgcagcctcccaaagcttatactttatcttatgttttttcagcattttaagaaacagcttaccatattttgacttttgcttcaatagcagcggttcttaccctgacggctgcagcccctaaataactgttttactttttttaagatttatggtaaattatcttttaataaaatgtattcaggttttttattactatggttgaaaaaggagatttttatgctggaagaagattatatcatgcgggtgattcatgaaatggtaatgactttgctaaaactggtttttcacattgatttaggaaaaaacgatgaattgaattttaggaatcaggaaacaggatcagcatacggtgaacttttggatctcattgaggatgggaagatcaatgaagcagaaaatcaattattggatgatctggattcacaggatatggagcattacaaaatggcactcatgttttatgagcacttaaatcaaaaaaattccaaatttcttgaagaatgcggtttttccaagattgaaatcgttgatggattaaaatacgtatcatcaatttatggctatgatgccatggcggaggcgcttcttggaagaggttctgaatgagaaatcataattgcatcaaaaaagggaaggcatcttcatctgaagacaccttccctttgacaatcggatattcccaatccgctttgctgcctgctcacagcgtgccccgcttcaccgggcataacctcatagctgcaggcattactctgacatatgggcgtttaacttatcaagcagcgtctctaccggaacgccatgtaccatgcaggcctcttccagggtttctcccgcagatgccgggcagcccaggcaatgcattcccatttcaaagaagaagggagcagtggtttgatccgcttgtaaaacctcaccaattaaagtatcctttgttactgaaagtttcatttaaattacctcttttctttccatatttttgtgtggtgtgatggatccttcggaaaataagccgttccctcccttttggagaaatacgtgttcaattcttggaaggaaaatccccaaagactcttttaacacatcctctacagtttctaccggtataatggtaagctgattcttcacttcttccggtacatcctttaaatcacttacattatcttttggaatcaaaaccctggttattcccgccctttgggcacccagaagcttttcttttaaacctccgatgggaagaaccgctccccgcagggtgatttctcctgtcatggcaagcctggagtccaccttattgcccgttaccagagaggccagggcagtaaataatgctataccggctgacgggccatcctttggaaccgctcctgagggaacgtgaatatgaaggtctctctctttaaaattaaaagcatttaaaggcagtctggactttaacagacttaaagaaatcttagctgattccttcatcacatctcccagctttccggtcaatgtcaccgctccgcttcccggcatatcggttgcttctatgaagaggatctctcctcctaccggagtccaggccagccctgtgacaactcccggaggattgtccggctgagccttgtcatggcgggaaacctgccttccaaggaattcctccaaatcttctgccttgatttcaaaaggcagctccactttctttgatacgatcttttctgttgtgattctggccaggccggacaactgctttttcagcccccggactccggcttccagcgtatagtcgctgatgatcttctgcaatacctcatcttccatcaccagctgctccggatttaacccgtgctcttttaaaactgccggaatcagatgattctttccaatatggaatttttcatccatggtatagctggatatctggatgacctccattctgtctaacagcgggcctgggatgctttctaaggaattggctgttgccacaaagaagacatcagataaatcataaggaagatccagataatgatccgtaaagctgttgttctgttccggatccagaacttccaaaagagcgctggcaggatctccgctgaagccgccggacataatcttatccacttcatcaagcaccataacaggattggtctttcccgccttccggatgttttgaatgatccttcccggcatggctcccacataggtcctcctgtggcctctgatctctgattcatcccggataccgcccagacttaaacggatatactttctgccaagggcttctgcaatgctttttccaaggcttgttttgccggttccaggcgggcccacaaggagcagaatggaaccttttttatctttgtttaactgcatgaccgccagatgctgaatgatcctgtcctttaccttcttaagcccgtaatgctgttcatccagaatccttcttgcctcatcaagatcaatgtccttttcttcctcctttttccaggggagctgaaccaggagatccagataattgcggatcacattgtaatccagtttgttaggcccctgatcttccagtttttccagttcttcaagagcagcttcttttatctcaggcggcattcctgcctcttcgatcctgcttaaataatccgtttcctttttcccggtttcctctttgccttcattcagctcttcctgaatggcctttaactgttccctgagcacggactccctgtaatacttattggctttctcagagaatttctcggaaatctgcatctgcaattctatcatttccttttgcttcagcaaataatccagaaaacggaggcttctgtcttttaaggactgcatttccagcaattcgtatttttcctcatttggtatctgaagaaactgagacaaatatacaataatggaatttaagtccgtaaactcattgacaactctctggtactgctctcccctgaaaatttggcgcttatctcgctggtaacgttcttgatgtaaccgagcatttcttcccggctcttttcatttagatcctcatgatcaggactgagctcatattgggcatatatgatgccgttctctatctgcagctcttttatattgacccggtctttaaacttgacggaaagcagaattcccttttccgactgatccagccccgtgacctcaaagatcacacctgttctgtaaaaatcctcttccttcttcgggtttttaccaaaattctgtttctggggcaaagctatttttacagcatcttcgtcttctaaatatttcatctgtgcttcgccaagcgcttccaaacgaaccgtggtcaggacgtccggcaataaaaccttattggatattgggaaaacgattcctatgtgatcattataattatttatcatagttttatcctttctgtgcgtagtccttaagtgaatgttcatttaatatagtatctttttttgcgagattcttttgtagaatggtttcacaaaataatcccgcttataaatttaccgcagtatcgcattctgtatgatctggatcatctcctgcagcaaatcctctttttgtgcttcgttcttgcgattatcaacggcaatcgcttttaccggctgaaaaataatagccagcagattatcttctttgtaattctttatgaggttgctcctcttcatctccgacatcaggctgtaaatattacaaatgccctttttcccggagcagttattggctaatgaagggcaattggaaaattgctccacaaagctgaagatttcctggttctccaatatatagttatagtagcttcggatgagcacctcgatctgctgccgtccctccatatcccgtcttacgctgtctaatatataatcatagatttcttccgagtattccaggtaaatatcgtgcagcatatcttctttgttctcaaagtagatataaaccgtagccggcgaaacccctgccatctttgcgattttagagacagaagtgccatggaagccctcctgcaggatcagcttgattactgcttctttaatgcttctcaccttttcgtcgtctttttttctcatgccatcacctctatgtctctataataaatgatcattcacttattgtcaactattttttgacctgatccgtttttcttttaaaattcttctggctgaacccatacataaatttataatagcttttccttgggatcagacctaaaaagcgggtgagcatcctagtatgtaatcccggaatgctgatgactctccccttctctaaatcctttaacgaaagattcaccacttcttccggtgacatccatttgaccggacctctgtccacctgccgccctttttccattcccatcttctcatgaaaatccgtatgcgttaatcctgggcagacagccatcacctttacccctgttcccataagatccatatgcagtccttctgtgaaagtctttaaaaaagccttaactccggaataaatggcattaccaggtacgatcataaaaacaccttcagaggatatattgatgatggttccgctgcctcgttccaccattcccggcaatactgtatggatcagtttcatcggagccgccacatttacgtttgcaagagcctccatcactgccggatcagaccgctgataaagtccggttgctccaaatccggcattattgacaagaatctctatcttctttccttttatggattccatgaccttgctaacgccttccgcctcagaaagctccgacaggatcacctctactcttacatagtatttttccctgatcccggccgcaacgctctcgattgtttccttccgtctccccgttatgacaagatcatatcccagttccccgaacttatgggcataagccgctccgataccgctggttgcacctgttatcaccgttgttttattctccatccttgttgacctcccttccagtcctgtttacattctttgctaaaatctccagaaggcggaccagatccctgcgctcagcagaggtttcataagatcccaatactttttcccataagaccttctctctcccccggtgttcccgctggacctctctgccctcttccgtcagttccagtccaaatgaccgccggtcccttttgctgattatccgtatcagcaggccccgcttttccaatcggtcaacagcgctggtgagcgtacttcccggtatgcccaatatttctgcaatctccttcaggatgacatcaggattccgttcaatgatgctgagtatgctgatctcaatggttgacacgccctccagttgatccttccatagctcttcatttgtcttttgcatggaaaagataagctcatgccaaaccttgtctatgccctttatttcttcctcggttatctggtccttcatgcggccgctccttttattacgattttcgtactatactatatcaataatatatttctcttcgtaataaatgtcaatcaaaagtcaggagaaatatagaaagccgctgttctcctgaataatggtcaggaaaacagcggccttgttcaaattttttctctgcttctattataacactccccttgtcatggaagcagaccgggaaaccagcttatgcagccactttctttagctcttccagataagcatttaaagccttcatgcctccatgctggtattgccttataaattcagtgcctattatggcgccgtcagcaccatgtttcatcacttcacttacatccccggcagtttttatgccaaagcctacgtaagccggtatttttgaaactgatttcactatctttacaacttccacatattcctcaggaagtttctgaaaggaacctgtctttccttcccctgaaacaacataggcaaacagttcattatgcttcaaagcccttgctatgccctcacggtcaagagactgacctaaaacagcgatctgattgtggaaggaccctggttgatattcctcatcaacacatatgaaaccatcgtatagattcttcggtacatgggaaaggcaaaaatgctcaacgccttccttataagtcattaataccactttaaaggcaaaacgcctgcggatctcctccagggtatgtatcatctccccttttgttaagcccttctccaaaacctcctcgtgggtctgccggatcacccctccatctacgtaaggatcggagacagggataccgatttcaacgtaaccggctttttccttatccaataactccagaatccggaaaaaggtttccttatccggataatgcagcgtaaggtaaaacaccagattcttcatcagacgcctccaaacagcttgaggatccagcctaaaatgggaccgtagaaggaataatccgtctcgcttaaaatacgcataataggcgcataggtcccgatcattggaagaagcagggcctgtccgaaaatcaggatgagtccgtttacaaaggagccgatgatggcgcccctgcgcccgccgtgagcatttccgaaaatagctgttactgctccggtgaaaaaggtggggatcagggccggaaatactacaaccggataattcacaaatcccaggatcatcataccaatcagtccggcaatcaagctgcttaaaaagcccagtatcacggaattgggataatttgggaaaagcagagggatatccagcccaggtacggagttgggtatgatcttattggcaatgccatggaatgcggaaatgatctcagaaagcatcattcttacacctgttataataaccgtgatccacataccaaaggacaatccccttaaaaagctgaacacaacgatatcctgtccgcctgttatgttttcacgcacccaggccggtccggaaataatgcttaagatcaaaaagagaatcgtcattacaatggtcagagaaatggtcatctcccttaagaaattaagcttctttggaacatttatattttcaagatcattttccttatttccgaaggttttcgcaagcaaagaggaaaccagtattccaaaggaactggaatgggcaagggtgaatccctctcctccttttacttctttcataaacaccgccacataggcgcaggaaaaggtcatataaaagcctaataaaagagaaccagttatcaccaatggcatgaaagccaggtttgttccgaattttaacaatgccgcaattaatcctgcataaaagaaggatacgtgagccgacaaatgtacatatttaaaacgcgtaaatcttgcaagcaaaagatttacaagaaagcccagtgcaaagatcagcgccatttccgtgccgatcccggaaagactttcgctttgggctgctccgatatccacagatacagccggcatacggaatattttggagatcattccctgcaaaggcagcagggacataccaagagtctgccctcctacgttgatcatggtaaagccgatcatggtcttgatcacactgggaaggatctggtcccaggttttcttctgagccaccataccggcgatcacaacgattcctataatgaaaacagcctggctgaaaacattattaatcaaatacattactactcccatttttctctcccttctgaggctgccgtcagcctgccccttatctcttgtttattgcttcaagaagctgctcttttaaatactgcttatccatcatattgtcgatccggattatgtgggccttggaatctcttaaaacatcggcaaaatccgaagtcgtgatcagaatatcataaaaatcagggcttacagaaccgatatccgaagcatctactgttgcttcaatcttttcggattcaaggatctgctgggtaaataaacgaagcatcatggagcttcctacgcctgccccgcatactgttacaatttttatcataatgaatccccctttataatttgtaatatttgctctgcagattctgcatttgttatttcttctacctttttagcatccattaaaatatccgcaagctcggtaagtgctttcaaatgagattgatgatcaatggcacaaaggcctacgacaatcttaaccggatcgtttttcggatgtccgaatacaacgggctcttttaaagtcacaatgctgaggccaatatccagggcaccttcctctggtctggcgtggggcatggcgattccgggtgaaatcacgatataggttccgttcacctcaacatttttaagcattgcctggatgtaagcctcatctgcaagtcccttatccacaaggagccttccgctttccttaacagcttcatcccggtttgcggctacaaattttgctttgattaaatccgcggtcagaatttcttttaacatcggttgataaattcctttcttttgttccgaattttctgtaattcctaaatatacactcaattcgttttttaaaggttccagcttatgatcttcgatctccacgtatttgccgatgatgttcatcacctcaggcaaatggatccgggcagtgagaaacgacaactggccctggatttcctttatgtcataatccgataaatacgggctgaccttcagcacctttgtatcctgccattgaaagggcactgtggatattattaagtccggaacatgctccatcagccacagcgcagcatttctcacgctgaacgtccccagtatatttacatgaaagatggcctgcagcctgcttttcaatatctcagaggtgctgatccccgcattgcatacaatgatgacattaggggtcctgcggatctgtttttcatttctttctataacagaagcaaaaaacaacgtgaaatatgatatctcatgttcatgaaagtgcaccttgagcttttcctccagcacctttacgccttttgccaccgccttattaagctgggcaaaattttcaagaacatagcttaataaaggattttctgcccactctcctgctaatgcccgtttataggcagggcgcagatgattcagcagtccttcataaagcttggaatccgttcgaaaagcttcaaaggggtattcctttgccacgacgtcgataaactggttggtcaccaggttaaagggcagccatttttcagacagcagctcttcggatttgacaacggaagcttctgccagcttattggccagataaaaacaatcatcaagagacacttccctgccaaaaattgcctcgatctccctgtggtgctctacaaaagccttttcttctcttgtcaaaatatccttggagccctgggtaaaggcttttcctatggatatccttgcatatgtgacgtaaaaggcaatcagcatgcggttaaaggatacgtcgctcagctctatattaagctgcctggctacatcgtcgagaaaatcttcacaggaatacaaaatctgcaagtttcttttgcccgtcctgtcttcaaaaaacaggagatcctcgctgatggaaaggatcagaagattcctgatgttccgttcctttcctgaaatccggtatcccttaaagggtgttgcctctactgcaatggaatgaaagctgagcatttccttaacttcttttaaatcaccgataagggtatttctagaaatatcaagctccttcagtaagtcatccaccgtaaactgatcgccggacaaaaggatagattcaatgatccgcagacgccggattctcggattccataaaacatagtccgaattggaatggatcaggctctcaaattcaatcatcagcggtgatttataaaacatcttccccttatccgcattgatttcagcatggccggaagcctccagcaattcatttaattttttaatatcactgtaaacagtcctggtgcttacagaaaactgctgcgccagctccctgacagtaaactcatgtttgctctggcagacaaggcggaaaatttccgaaagtcggttatccatggttccctcctttatgtgttaagtatagcattccaatgaaaccgcccacaaatccaatttacttcactttttttgaatggatgaggatatggcagtttaccgtgcattggaaacttcatattgcccgttaataacttttttgttaatatgataatacaataagaaatttattttaacattaaaaataatttacggatatcatggaggatgctatgagaatagaagaaatcacgtatgtatctaaaaacggcaaaaaagttgttttaagaagttctgagatatccgactccgatgcattgcttgaaaatctggtgagatgcgccggtgaaacggattatttgggaagatatccggaagaaatcaacagaaccattgatgaggagaactcttatatttgcaagctgctggaagatgaaaaaggctttgatatttcagcctttatagataataagctggtagctaacggaactatcgcctgtatcagaggaaatataaaaacaagacacagggccggatatgggatttgcgtttcaaaagattactggaatatgggaatcggtgatatgctgacaaaatgctgccttgagcatgcaaaaaaattgggctacgaacaggtggagcttgaggtggttgccgataataaaagagctgtccacgtatatgaacaaaatggatttaagatatgcgggactattgaaaatggggataaattaaaggatggtacatctcgggatttgctgctgatgatttgcagattataggttgatatagggcaatggaggttccggccttagacagaggattgctggctttggtattaagtcagcgtttttttgtagggtaattgaatctccccgttattaaaggaagacgggacgtctgtgagcagacgccccgtccctatcagacgtttcattaaaacagcattacctttttgaaatgatacgattgtaagggtctctttagctcctcttaggaaataccaagacctgcactggcatagcctgcgatagcggcggccagatcaagaccagccgtaacatcggcagagaatatcaaaagcaatctggttcctgcagtgaccggaatgttcagccctgtggtgatcccactgctgatttgaccgacagaaattattccattaagaggaggtgctagtgtgactactgcacccggtactgcaacgaaggtgttattaggtgcggtggattgaaacagctgggcggacaccgttacggtggagccaatcaagcttagaccggtactaatgctcaggtagccagccagggatgtgataaccccatctctgggcatggaaaacgcgaggttggtcaaaccaagcaaattgactgttccgctggcagcggcaataccagaaaggttaagtccgaatcctaccgcacttgaggtgttaagtactcctccgagtacagtgcttagggcaacaggtgtgccggatgcaaacggaattattgctccatcacccgctgttccagttggacctgtgggacctgtgtctcctgttaaaccgattggacctgtgggacccgcgtctcctgccaaaccgatggggccggttggacctgtcgggcctgtggggcctgtgtctcctgtcaaaccaattgggcctgtcggacctgtgggaccggtgtctcctgccaagccgattgggcctgtcgggcccgtgtctcctgtcaaaccaattggaccggtcggacccgtatcgcctgtcaagccgattgggcccgtcgggcctgtgtctcctgtcaatccgatgggacctgtcgggcctgtgtctcctgtcaaaccaattgggcctgtcggacccgtaggacctgtggggcctgtcgggcccgtgtctcctgttaaaccgattggacctgtgggacccgtatcgcctgccaagccgatggggcctgtcggacccgtaggacctgtggggcctgtcgggcccgtgtctcctgttaaaccgattggacctgtgggacccgtatcgcctgccaagccgatggggcctgtcggacccgtaggacctgtgggtcctgtgtctcctgtcaagccgatggggcctgtggggcccgtatcacccgtcaagccgattggacctgtaggaccagcggggcctgtggggcccgtgtctcctgtcaagccgattgggcctgtcggacctacggggccggtggagcctgtcgggcccgttgctcctgtcaggccaataggtcctgttgggcccgttgctccagtcgttccgataggtcctgtggggccaattgggcctgtggggcccgttgctccgattggccctgttggaccagttgcgcctgttgaaccgattgggcctgttgctccgattgggcctgttggccccgttgcgccgattggtccggttgctccggttgctccaattggtccggtaggtcctgttgctccgattgggcctgtaggccccgttgcaccgatcggaccggtaggtcccgttgcgccgattgctccaattggtccggtagggcctgttgttccgattgggcctgttgggccggttggccctgtttcgccgattggtcctgttggacctgttggaccgagacagcctctaggccctgtcgggcctgtcgctccggggcaccctctaggtccttgacacccctaggtcctgttgggccggtagagctacaacgacgacaacggcaactagaataataattatcatctgaatcaatacaattattcatatggatttccctccataattaattacttatatatcgaaacattataaagaatctcaattctttatagtgtagaatatgtcttgttgtacacgtctgttaattatagactaaatcatacatcataaggaatttactaataaagaaagaatcaaagaaactcattataccaagtcagtattacggatggataagttattagtaagaagtataaaaacagtctctaattgatagatgacggaaatcaaatttacctcctgttcccataaattagaattcgcccacccatcagcaccagatttgaaaatgttaaccagcatttttcttttagaactcgctgtaacaccattcagttaattgttcggaatttacttcgtcggcctcaaacacatattgtttacaatataaactgacttcaatatcatgcttaatttgctttcatcagcatcaaaactaaattgctgttttcaaaataaaagaattagttcttttaaaacaatatcagtaacggaactgctgggaaatatagaattatgttttatattcttacatacaaaaggcagaatttataaattgtaggaggaatattatgaaataaagatacgtaaaagctgggaagaaagatgcagatttattaattaatatttataacaatgcattccttggggattatgtaagatacggtgagtgccctgcttatggcaaaacaattgacgaaatggaagcttctattgaaaaatttccgaaactgattattttttgtgaagacaatcccgttggagcgatttcagttgatgacagaggaaatggaatatattatctgggctgcctatgtgtaatgcctgaataccagggcaggggaattggtacacaggcatttcattatatattggacctttataataactggaaagaattattgctggtaacccctgcggataaagaggaaaatataaaattctatacggaaaaatgtggttttatcattgaccgcattgagatggatggaagtgttcaggtggcgcactttttactagagcggtgaatttcagctttttccatgaatttttagtaagaaaaactttgaaattcacttaaaactcagaaactttatatcgcatatatcttctatcacatattcgtaaaccttcattcatacaagatgattgaatttcgtatatacgaaacgatctcagaaggtgctactttaccaaatcattatattctgggtgtttttcgaaccactttatagcataggaacacgtcagaatggcttttttgccttgggaacgcaactgttctgccacagcctccataagctgccctgccaccccctgacctcggagggattcatctacaaaggtatggttgatatctacggtattttggtcaacctccggaaaagtaacttcggcaagcaggttgttgtcagaatgaaaaagcgcgatctggtttggattgtaagtgaaattcataagtattacctcctatttcataataaagaaattatatcacttactaaatatggtatcaaggagtgatcaaagaattgttttaggagcggatggataaaaaatatacgcttaagcggaaattagatttttccagagtatttgccgtaaaaaagatagtagccgacaaggctggagaaccatgtcggctaagtgaaaggttataaagactttgtctctactgtcatagtataccatcacatcctgaaataagtctgaaataaaagtgatttgccataaaaagtgtgtaaccggtaaaatcgcggtgatcatgccaaaagcttgagggattcgtgatgagtttgtaaaagataatgatatattgagaactaaatatttgatgcggggaatatgcgtgctttgtacagctggaagcatatgtatatgacaatacctgttctggtacggtaacacgttatatgattcacaaccgattatgatttagggttacttgaacactagtattaattgtaataagttagatgacagcgtatttatgagaattatttatatctggttataaggaggaatctgtaatgaaactcgaaaaaatgggagccttttttgatagccgtttggacgactatgagaaccaccagcttaattttattgattcagcaaaaatattttatccctttacagcatcgcagctacctatgaccgctggatgtaaagtacttgatttaggctgtggaacagggctggaattgaatgaatatttcaaagtcaatcctcttgctataataacagggattgatttggcaagcggcatgttgaaagcactgcaggccaaatttccaggcaaacagcttacgcttatcaatggttcatattttgaggtcccctttggagaaaatatatacgatgctgccgtttctgtggaatcgttacatcatttcagtctggaacataaaattctcctttataaaaaattacatggttctttaaaaaaaggaggatattttattttaacggactatatagcagaaaacgatgatgaagaaaaaaagaactttatagcactctcccgcctgaaaaatgaattgggaatatgtgacggtgaattctatcactatgatacgccgcttacaagagcacatgaaacagaagccctgctctccggaggattttcaaaagttgaacttttgaataaatggcaaggtaccaacatactgaaagcatataaatgagtttttccttggattacggatattaagaaaagctactataaaaaacctgtgaagaaagttatcgggtatcagcatatagttggtaataaaaaaaatattgtattagtataactcattattaaaggagcaaaagatatgaacatagtgacctcccgtttacaattgcgtccatttacagaacaggatattgacgatgtatttgaatattgcagccaggaaggagtgggggaaatggcaggctggtctattcataaatcaatagtacaaactaagaaaatcctttcagactggatactacaaggaaggaaacttgcaatagtttggtatgagagcggaaaagtaattggacacatctccattgatgaggattcagaggagggacgtaaagataccagagaacttggctgtgcgttaaatcgtacttatcatcggcaaggtattatgtcagaagccatatttgcagttttggattatctgtttaataatgatgtctcatatgtttgggcatgttgctttcaagaaaactcagcttcaaggggcatgattgaaaaatgtggttttgcgttccaacaggaaggaacttatcattctaaagaactcgaaagaacattttcttcttatgaatatcgcctttcaaaaatggaatgggaggaacgaggtacaagatttgaaaattataaataaatacgctcttaagcaaattgaatacaaaagagctgcaaactatcagaattaagccagcggttttcttattgtaataaaaccggaaaactgatattggccgaagctcccagctccggccaaataattaagattcaattcatcatataaattttaaaattcagataagcagccactatgcaccataaaagatatggaatttgcaagtatgctgcaataggattaattttataaaacaattggatcattataattattaatatgattaatataattaaccataaaaaggcaagtaaatattgagaaaatccaaagaaaataatactccaacaaaaattgaagaatagttgaagtccataaatttttaaggctttggttgaattcgcatctccggacacaaaaattatgtatgatgatattcccattaaaatatacagaaatgtccatacaataggaaaaatatatgttggagggctaaaggccggtttgtttagcgaagcgtacattgacatatttccactaaaaaaagcggataaagacccgacagctaagggaataagaatagaaattattagagtacttttattaagaggcttcatatcatccaccccaagaatatttataacaatatatgaattcacatttaaagatatgcggattataaatcgaattacaatttagttaacttattgtactttgaaaactttatattgatagttagcagtcattgttttatctttattttattaaatcagaacttgtttggcagttttgaactgcccattatataatagttaggagatatgcaaaaatgaaaaagatcattaataaaagagcctttcaaattataggctcaataatattgtttagtatttcatttgtactatgtcattacactcagttagctgccttacatggaaagtcagatgccccgataattgtaggagctctcggtattgcagcacttttggtttcttatatcttcaatctaaaagcactgacaatcacagctactttcggttacgtaattgccttttttataggcgtgcgtttggagacagatggtattgtacatggaaatggagcaatacatgaattatgggtagtttggcttgttagttattgtgtttttattggtattggaatcatttatgattttgtaaaaagattaaaagataattatttaataggtgctgccaagtcaaaaaacgtagtgctgtatataggtttgcttgcaggtatatttatcgttttaggatccatttttgcttatatgacaaaaccgctcacaaggaacgatgtaattcagcataagcctaagtttagtggtacagtaattgaaataaatgacgatacttccattttagttcatgttaatgagaacgatcctataattaaaagcagcgataaaatttttgtttcacttaatgtcaaaatggcaaatatcagtgtaagcggacgggatcttgatataggagatgaaataattgtttattatgatgggattatcgcagagagttaccccgcacaaataaatggagtatatgcgatttttcataaaaattcttctgaatgaactatcgaatccataatttactttcaacccgtggttacatccatgcagtctgaaggattaatgcttatagttagaaaaaacacagtattctataaatagaacaataatttgaaggggcgattttaatgaagattgaaaaatgcataaaagaatcgtttatagtgattggaaaagaaggcgctaccactgacggaaagggatttattcaaaagctttggaggatgccaattcacatttcaatgaaatagcgcatttagcgaaaaaagatgacaaagggaatcttttaggaatttgggtgccatgtcggacttttctcgctcgtttaacccatgggataacttttcgcaaggattatatcttgccggagttgagtgcttagatggtgccgaagcaccgtatggatggactaaatgggtggttcctggatacgaatatatttatgttgagaatgaagataacgatactttttctggcgttattaaatatttaggagaaaacaatctctttcttgcaggtgcagtaaatgattttagctgccctgaaacaggtaaactttatatgttttttcctattcgcagattgcaggcagaacatgcttgataaatcgggatctaaacgaattgttgtacactgcaaacttcatattgatagttagtaaatttgatggtattctactcatgtgtttatttaatcttgagttttaaagacgggagaatggtgatgagtataaataaaagcaaagcggcagctctgttcgatggttgggaagaagcgttaatatggtcctgtttgcaaggtcatatggggaatatgtttttggataacgatgaaaatccctcctctgctgttattgatattgggatttttgcttttttgccggcattcccaatagtgcgttattgactgctgtcggtggtgaaaagctactgatacctaaagaccaatcctgggagatgttgatagaagatttttatggtaatagggtaagtaagatttttcgatatgcaataaaaaaagagccggatatatttgatgctgaaaaactgaatacttatatagaaacacttgattctcgttttgaactaagattatttgatcaggaaatttttgaaatggcacaaaatgaagcgtggtctgttgatttatgttcgcagtttaaagattatgcggattatcataacagagcaatcggtgcggcaattttacataatgggaaacttgtggcaggcgcttctccttatgcagtatacgatggtggtattgaaattgaaatagatacaaaacccgaatataggtgtaagggtcttgcaactgtatgtggggcaaaactgattttagagtgtttaaagagtaatatctatccaagttgggatgctcatgatttacgctctgtcgctttagcagaaaaactcggatatcaccttgacagtccatatgtaacatacgagctggcagacaggtaaaattacaagtatcactcatgatcaacaaaatgaatatacaaagaaaactactggctgttaatacttaagttagtagtttttttatgaaataatttattgatagaagctgagctttttatgacattattatcactgcaaattgatataaaaaagaagaatggaaccttgataaaccatgatagactgagatatatgcctaccggaataaagtcagtaaaagagttatgggaaaaattatagatttcagattaataatttgaatatgtaaagaaaatttgcagtctaaaaacttatgaggagatatgtttatgaatgtattcttgaaaaaagccaatattaatgagtataaagaaattcatgctatgcaaattgtatcatttagtgatcttcttgagaaatataaagactatgaaacaagtcctggtaccgaatctgttgagtctatagcgaaaaaaatcaaacaagagcatactgattattattttatagtacttaaagataaaaacataggagccattagagttgtaaagctttcagctaaagaatgccgaattgcacctatgtttattcttccggaaaatcaggggaatggctatgctaagcaaatattgagacaagtagaatgcttatatccggaagtgaaaatttggaagttagatacaattaaacaagagaataaactatgccatttatatgaatctatgggttataaacttaccggaaatgaggaaaaaattacggaatatatgacaattgtctattaccaaaaagaactaaataaataaaagtttaaatcgaaccatataagagcagggaaatagtcctctgctcttatatggtatgatcttgtatttaatttaattcattttttcaggtataataaaatatactatactcataaaagtcagaaaaaatgtagccagaggaaaccatataaaaagaaaagactttaacgttcttgaaggtgtatttatattattgacatcatagtaaagtttgtccttatataagtaaacttcgattttggattgtgtttccttgagaaattttagtttataatgttcagagtgtggaatggaatcagtaataaaccttttttcaccattataatcgacagaaacttttaatccactgtaccctaatgaatttctgattttgattgtcgttatacctgtattttccataaaaaaaaggataatgtaatgagtttcactttacatgtacgtaaaaatgaaattgagaagagaaaacctaaatgtagaaagtggctatagaaaatgtaaaaatcatatcatagtgaaaatgacataattataaaaccgaacaggctggcctagtccaatttttgtttcccttgaggattattgacaaaagtctgctgccggtcccagtggaaacgcagcagaaaaactttgccgttactataaatgccttatcatgaaggataccccatcatataacaggtatctgtaaatccgacttatataatctgagttagatttgaaaatattgttttatccctgctgagtttagcagtcgcagccattttcgctaacaatggcactgagtgttacattactgatatatgattcaagtacaatgggaacagcaacagttaccacgacaaaataagtgcagcagccctccatgcaggagtcacagtcacaatcacatacagtaaaattaaaggaatcagtttccgttgtggcaaccagcctggaataaccataaattccactgaccggagtagcagccgcctggtctgaacacagcctgaaaatttgaaaattatagccacctaatgcacctatataaatattagcagtaactgaaagctggatacagggattctcaaattccgaagtattaatctgtaatgcagtaagagtccgtgttgtacctgctacggtagtatcatcaaatgcaacaaatccgggacttccacattttaacacggttccggttagtctttcatgtttcttctcactgcagcaatcatcacagcagcattcacattcacatgtttcactcatattaaaacctcctttagccaggaattgaatgttataagaaatcagtaatatttatagaaatctttaccggcattatatacaataatatactgtaatcttaattaaagtgtgagtatttatgaaaaagattttttacgtaatagtctcgttaatttatcagtattaaaaatacaggaacactaaagaaatatgatgtattgtataatgaaatttatttatagaacaggaggcaaaaaatgcgggaatattttatgaaaacaaaaaggaccggcttctcaaaatggaatgccgccgatctggatctggctgttcaattatggggagaaaaagaagtcacccggtttatttgtgctgccggaacatttacaaatcaggatataaggaaccgtctggaaacagagattcataatgatgaggaatttcatatacaatactggcctgtttttgagcttgctgcagatgagctgatcggctgctgtggtatccggccttttaaatctgaatcacattcttatgagatcggtttccatctgagaaaaaaatactgggggatgggatatgcttccgaggcagcaaaagccgtcatagattacagttttgctgttttaagggcagataagctctatgcagggcatcaccctcagaacatggcatcggaaaagctcctgaagaagctgggatttcaatacatcggaaaaaactattatacacctacaggactgtatcatccgtcctatgaattaataaaccgtagaccaaacccataaatgaaaacagaacacatacataaaagctgctgacggtcaaaatcaggctgatatcttttatactcaaagcagagatgattggtctgcaaaacggaatttcacaaagagctttcagaaaggccatttatatcaaatgcaaacaaaagtagcaaaaaggcaactggcaggtgatacaaaagaactgttccctatgttaagatagtaaaaaacacggaggtgaatttccatgatttttccggaaaagttacaggtccttagaaaaagcaaaggtttaacacaagaagaattggctgaaaaaatatccgtatcccgtcaggcggtcgcaaaatgggaaagcggtcaggcatatcctgatatctccaatctcataggaatatcagaatttttcaaaattacaatcgaccatttagtaaaagacaatgattcctgcatcacttccatcgtcgctcaggaacccagcaacagcaaagaactcattgatttcctagttattgcaaaacgcaaaacttatgctgcaaagggtacagaatgcccgccttccagacccaattcccatgatttacaatacgaagaaggcagccttttgtatttagatacctatatcggcggcgaatgtttttccggtgaagaggctgtgtggaaaaacagcattcctatatatgccatgaactattccgggcgtgtaacaagcagtaattttaacagtgatttcctaaaggcagcattattggccgtacccagggaaaagccctttcgtggtccggccttatatcaggaaaacgattacgtttataacggcaaggtgtgtggggatttgaaatggtatcagggatacgaagaaatatattataaagatttacaggtttacgagtgttatttccacggtggaatcgtaaaataagataatgaacagaataaaccgccctctcaatccataaatgatcgattaagaaaaaacagtccatgatcacaccaggattgacacagtctaattttcgcccgattcatgtcaactactttccgtatgactcatataatattaatatcaacaaacggaaaggaagtaacactatgcccccattccctcctaacaatacatcccggggcggcccgacgcccatgggacctccgccgtcagccgttccccaaaaacctgcacagatgcgcgccggaaccagaatggtaagtcccggatccatgagaaactgcattggacgatttacttatgtctggttaagcaatgggcaggaattttggtttttccctgtccagatctgggctaacaccgtcgcagggttccgatgggatcgaagatttggctggtcatataccggaatttcactgaaccggatcgatatgtttacctgcacttagtgactatctttcaattcaaaaagcgatcctcaagggatcgtttttttgtatgtaactattcttttctcttagggtttttaggaaaccaccccttctctaccctctttttctgttctgcaagctccttaatgctccataaaagcgaaacacccaatactgcaagaagagccggcaaaacccctccagcggaaacaagagatagaccaatgcaaacagctcctgctatcagaaaaaccggccagattctgctggtaaaataatattccgctttaataacaacagggtgcaggaatccgataatgagaaacgttccgataccaataagaattccttcataattcatacttatcaccagccacttctttttttattgtctccggcccatccggttgccgcgttttaataataaaaataaaaacataattatgcagaataaaggcactgataagaaacaggcgtatgatcagattttcagtcaatacaaaagaaatcagcatcataaatcctgcagaagcctgaataataagcttctgttttcttgtaagtgaccggtcgcattcatattgctttacgtattttgcatacaggtttgtacctctgaaccagcaattaagtctttcagagccttttgtaaaacagagtaaggccagcagcaaaaacggcgtagtcggcaatcccggcagaaccgtcccagcagttcccagggccatagccatgattccaatacaaatatatatgacttttttcaataaataagacctcctgttcagcccctgctgctcaacaccatatggttgtatcaataatcattaatataattgtattggaatcacggtatgattattcacataccttccctcaggccatttctatcattatgattgtaaaagaccctcatctgtaagaaatgtccttgccacctcttcaggagtttttccgttcacatccacctcataggttaaatcagtcataatttcattggtaaacaggccgcccagcatattaagaacctcctccagattaggagcgacatcctgaaaacgctcaaacagatcattgcgcactagcagggcgtcattatattccggaaagaatttcaaatcatcctccaacaccttgagccctacttttttattcataccgtcggtggaatacacctctgtcacatcaatgtttccattttcgatcgcggagtatttcagcgccatatcaattgcttttccctccttaaaattaaggccgtaaaattttgtaaaggggccgtatttcatacttccctcttcactgaaaaattcatgctcagcgccaaacaccagatcaggtgcaagatcaattaaatcgctgatggtttcaagtccgtgctcatcggccagcgcctgggtcacagcaactgcatatgtattttcatgccccagcggatcaagcagatgcactttatctttttcgctggcaagctcattggcatattcataaagtgtcttatcctccggcacctgggatacatccacctttaaataagtggtgagcaaagtgccgtcatagctgttcataagatcgctcccgcccccgaaatcagatcgcggtagttgttgacaggagacatttcatcacggatttccactgtggcgtccgtgtgctcttccaccagcatttttaccatctggtgaataatcttcatttctgaaaattgaccgtcgtaaattacaatggaacttttagcattttgatttctgccgcatcccactaacattccaatcataaatagtgcacttaatattaatgttattccttttttcatcttttcctcctgttcgtcaattaaatggtacgattactttcaaaattcagacggagcgcctattcagcagcctcctttcgaccagtgccataccgccgtcaaacagtactgccagtgccatcagcgtaccggtgccaaaaagaatcagccgcatgttctgagtgcggatcccctgattgatgacagaccccagtcctcctcctcccaccgaggtagcaaataccgccacccccaccgaggtaaccgtggcaattcggatacctgtaaacaccatgggaaacgcaaggggaagctctatactgaacaaacggtcccatttggaaaggcccatgccccgtgctgcttcctttattccatggccgatactttcaagacctaaaaaggtgttgtgtacaatgggcagaagggaatacagtacaagaccaataataacggtcgtcttccctgcaccgaacagcagcatgaccaggcccagcatagccagtgccggcactgtctgcagcagctcacttgcccacaataccgtcttgcggacaggcgtataaagataagcaatgatccccagaggcaaaccaactgccgttgaaaataaaaccgagagaaataccagatacaggtgctccaatacaatcttagccgtcattttaagctcacttcccttccctgtctatgagtaatacggcgtttcacgaaatcaataataaggctcagcgaaattgccataatacccgccggaattgctcccgctacgatcaaggcattattattggtggcaatgccgatataaataaattcgcccagtcctcccagaccgatcatggaggccagcactgcccagctcacggtataaaccgcggacatccgcagaccgccgataatggacggcatagccaatggcagctccacctcaaaaagactttgaatttttgacattccacatccccgggcagcctccagcaaactggaatccactgaaagcagacctacatatgtatttttcagaataggaaataccgcataaatcgccagcgcgataatggcagtagcaggcaccatacccatgtataaaaacaaaataccgataaataccacaccgggaatggtctggaacacggaaatcagcggaagcgcaaccttggcaatcccaggcacccgggaaagcaggattcccaacgtaagagcaaccacgaatccgcttgcaactgaggcaaaaacatataaaaagtgaactcccacggcaatcagaagcttatttccatacaattcccaaaaattcattgtccatccccccacaaagcatcggccatggctttcgccatgctggttttggtcacaattcccgctatggtatcgtcctcatgaagcactaccacatagctgctgtccgtgttaagcagcttatcaaagctttccatcgcgctctcggacacataggataccgcattctccgaaaccggaacctctccgatggttcctgtgcttttgttggcctttttaatatcacccacagtcacgaccccggcataagaatcatcgtcatttttaatcagcagggaatcgatctgcctccgggccatgatttcggtacattcgcgaatcccgcggcttttatatacgctgacgggatcaggccgcataaaatcggctgctgtcagcgccaaagccggactgcctgcagcacgttttcccataaaggtgcggattaagtcgctggccgggctttccagcatcttctccggggttgccatctgcacaattcttccgtgttccataaaaatgatcttatcggccagcttaagtgcttcatccatatcatgggtgacaaaaacaaaagttttattcagctttttatgcagccggctgatttcatcctgcagagaatttcgggtcatgggatccagcgcaccgaagggctcatccatcaatacaaggggaggcgatgctgccagagcccgcagaaccccgatccgctgctgctgaccgccggaaagctcgaacggatatttatgcccatattcctcataggacattcccaccatgtccattaagttccgggtaatatccaaaatcttttccttggggtatttcaggcgctttggtaccacaccgatattctgtgccaccgtcatgttgggaaaaagtccgatctgttgaatcacatagcctgtctgcctgcgcagctgcaccggatctgtctgagaaacgtcatttccgttcacataaatatgcccggtatccggctcgatcagacggttaatagatttgagggtcgtggtttttccacagcctgaagggccgattaaaacagcaaattccccttccttgatttcgaagctcaggttatcaagaataaccgaacctccatacctttttgttacttgttcaaatcgaatcataaatctcctttctagaagaaacagcaagacgacctttgattcttatgaaatttttcttttcaggtaacaaaaaaagcagccacccaatgtttggccatcagatattctgacagccataatttggataaagctccttccatactaattaaaataagatttatttatttgcatatgcgagatattgcctgttaaacacaaagcaaaagtacagaactttttttaaattcacctcttaaaatcctaagaaaggattcatccaaatcaaactaaattgctattcagttgtcgctcactatttactttacagctatcctgataaagctcttctatgtaaaagcatacagtaaaatccccagcatgtcaaatctgacaggcattttttaatattttattgttattattacaaatatttttcacttgtcctacggttgtcatgtttaaaatcagcatcaatacattataaaataaaccatccccaagtaattattactttcatattgaccacggccgaaaaaatcaaattaaatgtcaaagcaagcctccctaattcatggggttatttatgcagggaacaagatcccattctattctgtatattccagtttaagatttttataaaacaaataaaacaagcttaataccgttatggataaaggtattaagctcgaaattatcaagtcacatccacagcatgggctgacgtgtggcaatgttgcgtctggcttcttcatccgtagattcggccggaagccggtcatacagctccagaagctcttttctgcccagcgaacaccctgccagcatcataaagcctgccctggcaggaaatgcatcaaaatgcatcacatccggcggataaggccaggattccttatccagtatataaggagtaataaaatccagggcattttttatgctctttccgtcctctgatacatattcccacaaatcatcatccggcttagacagcagatggcataaggacaccatattgtccacaacaaagatggagtaattatagggctttgtacgccccagctctctcggaaaagaaccatcctccgcctcctgccttaaaagctgcctcttatagtaatccctgcaaaaatctgctatccgctcattatcagtaaataaggcaaatgctgcggcctgaacaaagaagcagacaccatggttattatccttgttcatttcctggatcccgttgctgtcggtcagcatccaccccagatatttagcaaaccatttctttaagccaatatatatctcaatcttcatggaatgggacccttttaacttctccaccgcaaataccacatctaccagatgaagagtatcaatgataccgatcccccttccggagcagatgccaaggatcgcctgggcataagataaatggggcgccatatatgtttcttcatccaggaaaaattcctttaagtgctgtaccgccttttctgcataggcctcttttcccgtaaggcagtaagccgaggcaaggaacaccacattggtcctcatctgacgcataatgatcctgtggctgttaaaattaccggggtttgtctgtccgtctttctgaatataaggcagcccgtccggggaatcgggatccggccaccagtaatccccattggaataataatcatgaggacccccttcgcttctggggctctgtacgtcagtgatatggagcgcaggagccttcatggccgcctgcgctttttccattaaccattccttattgggccagtcaggaacaatcttgtatttcttctcatattgtatcatttatatttacctgcacgatttatttaattctgccgacgcacaccttaaaagagctttcatgtatccggtgctgtaggcccaggaagagttttctccgcctacgccctctccccataccggcacatggtccacgtgaatggaaccgtcataatcataacgcaccagctgcttcatcacttcatacatatccatgtatccgtcttccagaagggtctcctcaaaataaggcatagtagcactgacatttctaaagtgtaccaaaagcaccttttggttttctacaaaatacttgatatcttccatgacatttccaaaggcttccccgccttccagccagcatcccagacacatcttcatgcccagataggggctgtttcctgccagttcaaaggcatgtttgtaatcctcggcagaagtgattaagttggagattccaaggaggcaatctacgggaggatcatttggatgaagagcgatctttatattggcttcttcacataccggcaggaccctgtccaggaaatatttaaaattttcccacatttcttctttggaataaagtctgccatgggaataaggccgggtcttcagttcctcaagatccacgatacgtccgatgcttcctcttgtatgctcgcccaccccaaacctggtagtcaatacctggttcggttcccacgtcatgtatcccaccggaatccctgcttttcctaaaacgcggttgaaatcattatacgccttaatggcctcatcccgtcccggcaatcccaaatggatcgcatcgctcttatacaaatgtacatttcctgcatccgttgccgttaagccgaatttgtgaagccgttccataaatgacatgaccgaatcataattggtatgttcatccgtaaaaataacgtatacatagtttatgcccatctgtttaatgaaccgtaactgttcatccgtataatctgatacaaccttggactgcacctttatcttatctcccagcatgttgggtcctccttaaagtcaaataatcagctatttggtccagtgaacggcttccggtgtccactgttccagacttacatcataaatcccactgtctttcactcccggaacggcaaatgattcataataaataaccgccattggagtaatcatcacataatccgctacaagcgctttagccgccttctgaagattttctttcttttcttcgatcgttacagctgcccgtgctgcaaacagaggttcttcaaattctgccggacgaagcataatgccatgatttttaattccttctgaggaatacagacggatatagttgttggtgaaatccatcttgctggctccgcggtttgcaataaatccatcgatgtcatcttccttctgaatcgctgccagagcagagctgtccagcgtttctattgctgccttgattccgatctgagccaatatggcctgaaatgcagtcgctgtgtcattgtcctgggacttagtataaatggttgtctcaaatccgtttggatatccggcttctgaaagcatctgctttgctaaatcaaggttatactcataaaaatccaccggtgaataagcccaggaatcagaggtacaaaacagcggtgtcgcctctcctaaaccgccggataaggctttggctacctgctcccactcaatggcatgcataattgcctgccggacctttaaatctcccattggatgcttgtcgcttttgctgttccagataatgtgcttgatatccgcacagtttgcatttttccttccaatgctttcaaatccggcctgtttcacggcattgataattgcatcattttcaaacttcattgccacgctgacttctttattcagaagagccgacattaaagtattggtatccataaccatatcgatctccagctcatcgatatggggaagccctgcaattctatagttatcgtttttggtgtatgtaatcttattgtcaacaataaaagattccagaatgaagggtcccgttccaaccgtatgagtcttgcaccactcttctccattcttctcatacgcctcttttgagataataaacacatctcctatgacattgtcccagtcatttgcccatttctcatactgaatttcaatacgcctgtcatcaactaccgtgatttcctttggggatcccaattcactggccttgccattatcaatatacttctgaaggttccaggccaccgcttccgcatcacaatccgatccgtcgtggaatttcacgccttctctcagcttaatgctgaatgtgagattatcagggtccgcataaaactcttctgccagccatggataataattgccttcctcatcagcccgccccagtgattcaatgactggctgtgcgccgaaacggtcacttgtggttgttgactgaggcataaagaaggtattatggacctggggaatagcgatcaccagttttcctccttcctcaatatccgcggagacagaagcttcggtttctttggattctgctgccgtggtctcaccgctctgggtggtggtttcagcaggaacttcggttttcttacttcctccgcatccggcggtcatacctgccgtcatgaccgctgccagtgtcagcgccacaattctctttgttaatttcataatgtaatcctccttcaattaagtcatcagcttatatttaaatgaatcatatagcttttaatcgtataagaaacatgccacctcatgatgatctccaacatcacgaagtgccggaatttccttgcggcaccgctcccgtgcatgatcacatctgtcatgaaaaggacagcctgaaggcctgtttgtcaggcttggcacctcacccctgatgggtacccgttctctggattcctcaacagaaggatccgccacaggaacagcgcttaacagtgtctttgtgtaaggatggagcgtattgccatatagctcttcacaatccgcgatctccacaactcttcccagatacatgaccagaatccgattgctgatgtgtttcacaacggccaggtcatgagcaatgaataaataggtgagccccagcttggactgcagctcctccagcaggttaatgatctgtgcctgaatggaaacatccagcgctgagataggctcatcgcacaggatcagatccggctcggaagaaagtgctcttgcaattccgatcctctgcctctgcccgccggaaaactcatggggtacccggtactttaacgcaggatccagtcctacgatccggaacagttcatccaccctggcattgtattcctccttgttcttcaccagcttatggaggaggagggattctcccacaatggactcggccgtctgccttggatccagggatgagaacggatcctgaaagatcatggatatctttcttctgaacggatacatctgcttatcgttaaagcccgcaatatccgtaccgttaaaaacgatctgtccctcctcgggcttgtacaccctcatgatgcatcgggccagagttgttttgccgcagcctgattcccctacgataccaagagtttctccctttctgaccgaaaattcgatttcctctatggcttttacatctcctacctttttccggatcatgcctttgtaaatggggaaatacttccggacgtttttgacttccagacagatatcctctcctatttctatccttggtgccttttttatttccttagcagcaatttcctctgcttttgccagcttttcttcttctgacaaatgacatgcggcaaagtgcccttttccgatttccttgagttctggcttggaactttccctgcacttatccatacggtattcacaacgctcataaaagggacagaattccggtctggcggcaggattgggcggaaggccgtcaatggggatcaggatacggtctttgggatcatcaagccttgggatggctctgagcagtgccctggtatagggatgctccggatccgcaaacagtcgtttcgcatctgtcatttccacaacactgcctgaatacatgacataaatgcgctcagcaaacctggccacgatccccagattatgggtaacaataatgactgcagtattagttttcttggcaatatccctgatcatttccagcagctgtgcctgagtcgtcacatccagagcagtggtcgcttcatcggccacaagtatggtgggttccgatgacattgccatggcaatcatgatacgctgacgcatgccgcctgaaaactgctggggataatagctgaaacgttcctccgcatccggtatattaaccagcttcagcatctcaatggtgcgttttcttgcctcatccttattcagcttaagatgctccataatgttttcctggatctgataacctatggtcagaacaggatttaaggaagtcatgggctcctggaagatcatgctcacttttccgccccgcatttgacgcatttcctcgctgttttgaccatactccagcatatttcgttcatttccccggatgtagacctctcccccggtgacctttccgggagagctgatcagctgcagcatgctcatcatggtcactgatttcccgcttccggattcgcctacaatgccgatgatttctcccggattcaaatacatggatacttcatccacagcctttacaagctggccatcggttttaaaacaggtttcaatattttttatttccaacaagtgttccatttttgtctcctcctatcaaacctcgcccctgagtcttggatccaaggcatcccgtaccccatctccgaacatattaaggcagataaccagcaccgccacacagacgcccggagtaagtgcaaacacagggttttgaagaagaaacagccggccgtcactgaccataccgccccaggaagcagttggcgcactgattccaagcccgagaaaactaagtcccgcttccgccagaatggtctgtcctacctgctgggtcatcatgacaataataggtgaaatgctgttgggcagaatgtgtttcagcatgagcctgaaacttttgttgccctgcagctttcctgccataatataatccgcctgtttgattgtaagaacctgtcctctcatcattcggacgtaacctgccatagaggatattcccaggatgatcgctaagttgcggattccgcttccaaatacggctgtcagggccattgccaggatgatctgaggaatagcgcggatagcttccatgattcttgtgatcacatcatccacaaacccgccgaaataccctgcgaccattccgaaaaaggttccggcaatgcaggcaatcatcactgcaaatacaccgatgatcaggctgactctggttccatatatgatcctgctcagaacatcccgcccgtaattatctgtacccagaatatgatctttgcccggtccctgcaaaaaggaggcaaaatccgcataattgggatcataaggtgcgatcaaaggtgcaaatattgccatgagaacaaagagggcaaccacaatggcgctgaaagcggcgacctttctcgcaaacaatgtcctaactgtttttttccatcttccgttatttttcatgattctgcctccttattcatagcggactcttgggtcaaccactgcatataaaatatctgtcataaggttgatgatacaggatacaagagccgtgaccagaacacatgcctgaacaaccggaatatcccttgactgaatggcctttacaaataaagagcccattccgggaatgttaaaaacggattctacaaacatagagcctgccagcatggaaccgagacgcattcccaggatggtgataacagggatcagggcatttttaagcgcatggagataaataacccttctctgtgaaatccccttgctcctggctgtcctgacataatcctggcggatgacctccagcatgctggaacgtgtctgtctggttaccgttgcaattcctccaagggcaaggcagaacagaggcataatggtctgtcttatgcctgtcaccagatccacatgaaaccatgtaaacccataagaaggaagccagccaagcttcatggcaaatacatacatgactaacagagcgatccagaactggggcaggcaggccgttatattggcgatcagggtcaccgccgtatccgcaggcctgcccctgtatactgcactgataaccccaaaaagtattccaagaggaatgcttattatgaatgcactgattgaaaaaaacaatgtaataggtattcgttcattaatgatttccaacgtacttttatgaaactgtgttgattgtccccagtcaccctggagcgctcctcccagccagctgaagtacctgtgaaggacaggctggtccaattttaattcatgatataccctgtcatattcttcctgtgatacttccgatcccagcattgcataaaccgggtctccgggaatcaaggataccagcatgaatgtaaaaatggatatgagaaaaatgatcaatatcatctgtcccgtgcgtttcgctatgtatgccttcatttcatctttatagcaggagcttatatcctgccatattcctccctccctgcataactcctttttttatttccactgttattgctattttcattattgtttttctctgatataataagaaaatagctgatttttaattgataatgcttcatctcctttttttaatataatttttttactactttcaggttataattatatctttacttatgcaatttttccaataaccctttcctatttttattatagcctttacttataatgggaattatactttttaagaaagcaggagcttccatggacatcagatatctggaatacatactcgccctggccgagaccggcaatatgaccagggctgccaaaaaactttacgtatcgcagcctaccctcagtcaatttcttaccaaacaggagacagaactgggggctcccctgtttcaaaggtccagcggtacctatacacttacaccggtaggcagcctctatgcggaatatgccagaaacgttctctccttaacggaatccctggaaaaagacatcaaacgtgtttccaacaccagccgcatccgcataggtacctccgcttccagtgccctgcagatgctttcttgcatcctggctgatttccgcaaatattaccccaaagtggagctggttctgtcggacgataatctgcgttccaccagcaatctcattttcagaggtgaactggatcttgcctttgtaacagccaattccctggaacaatacaaaggacagagcattgaattgataaaagaagaagttgtatttgcagcccccagcatccatccctattgccagaagctgagcggaagccgtaaccggtccttaaacagccagcagcttttggaacacttttacaaatatccgtttattttacagcataaagggtcctgcatcaggtacctgatcgaagaatttttcgataaacaggattttaacccgaccatagcctgcagcacttcccatgcccaatccatttgtgatatggtgtccagcaatattggtgtaggctttatccctgccgggaatgaaatttccacgaaacagatcacctttttttcactggaacccaggatataccggattcattccattctttaccggaaagatctgatcatgaaacctccccataaatacttaatcgagctggcaaaaaaatatatggatacaaactggaacaatttatccagataattattaaaagcttttaaccaacaaaaaagaaggtatcccaaaagtcataaagcaactttttaggataccttctctttgcattttttatcttcctgtcttcctccctgccgccttttccggcacccgtttaaacttatcccctttgcctgttcatgtaatatctctttttatacatcacccctgcaaatttgcttattttacggataatattataatttacaaaacctcccactgcacctacaaccggaatgccctgtataaactttgcggttaataatgactctgacagaatccctgctgtggtttttatctgctcctctaaatttatttccgtcataatcttacaatccatgctgtcccccaatgcctcaagcttttgataaaactctttctgccgtttctgtttcgtcatggcagtgcagatcaaaagcagaatatatgctttttcttcctctgtttcataatcatacccatagcttaacgcaatttcataaacagatttcatgactaaggataaaaaaagaggaatatccggcagtccgataccaaatgcacccaggacacctccttctattacggaaatggaagaattaatcatctgggaatgcttggaatacttatccaaacgttttctgtattttctttcggcgcttttgcccagggcataatcatttaaatcatattccaattgtatcttatccttatcataggtcttctcgatataaatatttcccttttcaaaaaccagcaaaaatcctttatggaatgccgcctccagagctgctttcagttttcccggaatataactttgtattttatccgcaacaggctctacagaagctttcaggattgaattttctttcctgttaagcaatttttgctcttcttttttaatctgcttcacttgcttgtcaaattgacggttcatatatggtgccctctcctttctaaaagtgactggatgcatggtgaaaatcatgtatgttatttattaagaattttcccttctcttgaccattgtaacccggaacaatataataatcataaaacagaccgctaacctggtatggggaaacccataaccgcatcagatgaacagaaagggattttttatgaaattatacaaatacatggttttccatacatttttcctcctgccgctccttctgacgggctgcgggaagtatgttccctatatcagcagccccaataccgaaagcaccgggatttcccaacaggcttcaagcggaacagaggtctctcctgctccccaatccacggaagccacagcagaaaccgagcctgaaaagactcctgacagcggagcggccggacagacggagtcccctttaagccaagatctctatgagaccagagccagggaactgttatcttccatgaccctggaggaaaaggtgggccagatgttttttgtccgcctgcgtaaagacagtgccattgaggatatcaaaacataccacctgggcggctttattctgttcggagatgattttaaggatgagacgaaagacagcatcaaggagcttattaaaagctaccagagtacctcttccatcccactgctcatcggggcagatgaggaagggggtacggtgtgccgcgtcagcaaacatacagccttccggtctgagccttttcagtctccccaggatttgtataaacagggcggcatggacgccatccggacagataccagggaaaaggccgcccttttgctcggacttggcatcaatgtgaatctggctcctgtgtgtgatgtttcttctgatcccaatgattttatttaccgccggtcctttggccaggaagccggagcaaccgccgattacgtcaaaacggtcattgaggaaatgaaaaaggagaggatcggcagcacgctgaagcattttccaggctatggcagcaatggggatacccatacaggatcggccacggataccagaaattatgatcagtttgtccggagcgattttctgcccttccagaccggtatccaagccggagctgacagcgtgctggtatctcataatattgtgacttccatagatgaacaatctccggcctccctttcccctgcggttcatgacatcctaagggaagctctggactttcaaggcgttattatgaccgatgatctgagtatggaagccattaaggatcatacctcagatgccgatgccgctgtccttgccattactgccggaaatgacctgctggttgcaacagactttgacacacagattccggccgtcttaaattccgtaaataacggaatattaacagaagagcggatcaacgcctccgtagtccgggtccttgtatggaaactgaagctgggaattctataaccggcccgcagcttcagcctccccatgacattcatttctgccttcagtataacataaattcaaaaatccgggacaatttttcatcatcacatatgttaaaactgctgacggcaattgtaaggaacatgtaagaggctgctttgggtctaatttatgatttcgtattatgattagcaaatgattaggaaaaagacgtggcaggcagagttaagaatcggattaggccgtatcatcttatgaagctgttctgtatactctccagattactcctgtactgggtataaaggcatctggatttcccatggaattaaatccggtatccacaatatacattgctccgtcaggtccgaatataagatgggatagtctttccagccctcctgcatttgacaaggatgccggaaatcctgttttattaattgcaaatgtgctgatcgttctggatctcatatcaattttagatattctgtgtcctgcgctggcataggataccgaatcacccatctgtgtatgtatggtactgccatattccgctatataaacatccccataaggaccgaagtcctcattataattaaactcaaaccctcttatggaggaattcggaggaaatgtaacataaggtcttggaggaatgttaggctgatttttaagcagaagcgttggctggattcctcctcttggtgtgaaccgcggtgagtttactgcctctcctccggagtagtccggccagccataccataaattaggtgtaatataataaaaatcatccgtcgcattttcaatcggtctgctcccgataggattatagccattgttggctgcaaataactgaccgtttatatcaaattttaagtatgttggattcctgaatccccaggcaacttgttccagatttgaaccatccagatttgaccttaagatgctgcccgaagctttaatatatttttttctgatttcatattctatattcggtattccataaggagaaaatgcccctgttgcagcagtatcattgggcagtgcttctgtcagaatatttctggttccaaaattctggccataaagcataacataatccccagaataatcacatagaaacggagaaactgtcacccatttgttatcgttgcccacaataccgctgttggtaacagttccttggccgaaatacaatttattatcagatgaaaaagcgaccggactattgtaattatcgccattactgggtaaacccataatgatattctgccttgtaccgtctccgaatattttagttacataacctctatgagacacatatatgacaccgtttaaataattaatgcccgatattgggacaacaaacccttgtgcaatcgtctcaaaatgaccgttgatcaattgcagtactctgggattaccggtcgctaatccggaatcagctataaaaacatttccagcctcatcaaataccattccaattggggaatccaaatttttcataaatgcctcaatctgataaccttcgacaatataaatatcctccggattcaaatatcgttccgttgagggatcgatttggttacaagagagcactcctctgctatttttacctcgaaacattaacttcaccaggaaattttttactaaattatattcgggtttatttaaattatacgatgaaacctgtcacccttccttgggaatggtcacagtaaagcagcttccctgttcctgcacgctttctgctgtcaccgttccctcatgggcggcaacgatggatctgacaatggcaaggccgatgccggcgccccctgatttcctgttccgggatttgtctgttctgtaaaaccgttcaaagatgaaaggaagttccttttcaggaattcccattcccgtatcctttactttaacgattgccagccggtctgtttcagatacatggatttctattgctccgccttcaggcgtgtatttgattgcattggaaagcagattggcaatgacctggctgaatctgtttttatccgcctcagcaaagaccggatttccttctatggaaagggacaggttcttcttgaccatctcccctttcatggtatctgacaccgtgcatacggtttccagcagatcggtccgggatttatttaaaaccagattttcactctcgatcttcgccagctgccccagatcctcaaccagcgtcccaaggcgctttacctcttcatgacagcttttcagccgttccggtgtcggatcccacaggccttctatcattgcctccagatgggagcccagggcggtcaaaggcgttctcagttcatgagctacatcagcagtcatctgctttcgcaatttctcctggtctccgagagcatcggaaagatggttgatggcatctgcaagatcatcaagctcccggatctttgttccgggctcaaaccggatgttataattgccctttgatatctgtttggcaatataagcggttttcgtaacaggacgggatattctccgggcaagaaggcagcccaccaccacggaacaggcgctggataagattccaatgaccagaaggaccgtgttcatgacattaatgaaattaaaatcagcctcgttcataaaaaacgggccgtaatatttaatagacacagccccgatttgttttccattctgatgaatctcataagtatggtctacaaagccgccgacagtgcctctctcttccattctcaacgaaatttcgctcatgatctgcccgcaaagactcatgtcatgattttccgcatcccataccatgtttccccctgcatcaaacagctttacgatgtatccgtcatacagagagttcataccgatggcatgaacgtagtcaagcttccagctccgtttaaagctatcgtattgcctgcttaaatcatcgacgatattttcccttcgttcctgtcccagccgggtgatgtatttctcaaattcccggttcatgatccagttggaaagaatgccaatgagaccaatggtaatcaaaagcgtcagcagaatggaaagggataactgttttcttaaactcttcactctccatcccctccgaatttataccccagccctgggattgtccgcacatacactggatttttagggtcgtcctccaccttttttctgatgtttttaatgtggctgtcaatggccctgtcatatccggcaaagcccttgtccaaagccgtctcaatcagttcttctctggtaaagacctttcccggatacttgatgagcacagacaggatttttaattcgcttggtgtaagagtcaggctcaccccttttttacggacctcattcttctcaaaatcgatcaccagatccccgtttctccaggaattcctcttgacaaggggcaccaggtcgctttccgtccggcggagaacggcctccaccctggcatacagctcttttaagccaaagggcttcaccacatagtcatccgccccaatacccaggccctccaccacatcggtttcatccaccttggcagtcagcatgatgatgggaacacgggattttttgcgtatggtcatacagacctcttctcctgagatatccggcatcatcaggtccagaataataagggaaatattttcagaatcaaatatttccagggcctttctgccgttttctgcggggaatgtgcgaaatcccttactctccaaaagcaggcagactacttccagaatttttggttcatcatccacaaccagcacatttttgctgctcttaagcatcctaacacctctatccttctttcgctgcactcaccataaaataaaatacagaaaggcgggaaccgccttgttgtgcggtccccgtcccctttatttcttattcaacgacatcatagccctgatcttcaatctcagatttgatcgtttggacggaagcctggtccggatcatgatccacggttactgtttttccttccagatccactgatacaccggatacgccggatatggcgcctaccgcatttgtgattgccttaacacagtgttcacatgacattccatctacctttattactgtttttgccatttgagttacctccgtatgatattttattttaaattaaaaggttttaaaaacttatagacctccagtgtctttcccttttccattacagaaaccggcgcatatacccagccttccactttctccggatcaacaccggctgcaatgaggggttcgggattcaatacaaaaacaatatccttatcctgatcttgattttttacggtattggtttccatattttttgcccattcaaacatattgccgtctcccagctttaccccatagtggtcaaggtccatatggtaattgatggagtcccggtggttatttacgatctgctcataagcggtgagaggagtgatatctccctcataaaccgattgatcggttcccagcttggttcctaccatcagcattccttcataggctgcataattttccggcagcttttcggaatcaagtcccgcaccgacaaacggggccgcatcaagctccagcatgacgtcatgaagagcgctcctgctgtaatcttcactccagatgaagcgtacgctgtcatcgggtgcacttaaggaccagcccgcattggtttcatcggcctttacattgtccggaatcgtatttaaaaccgcttcaaacgatgtgacggactcttttcccactacatctaagcttcctccggctgtctttacaaccgctgccacgatcaccgctaccaaaacaacggctgttcccactgctgcaattatttttccattcctgttcatatccggtcacctcgttcctgtggttggtttaaatcttttcagccgcaatgcattggtcagcacagaaacagagcttaagctcatggctgccgccgcaaaaatggggttaagaaggggcccgttaaagagcagatgcaaaagccctgcagcgatggggatcccgattacattataaccaaatgcccagaaaaggttttgtttgatattgcggatggtctgcttgcttaaattaattgctgtaggcacatccattaaatcagaacgcatgagaacgatgtcagcggattccatggctacgtctgtaccggaaccgattgcaatgccgatatcagcctgggccagagcaggagcatcattgatcccgtcaccgaccatagccaccttgcggccctcggcctgcagttttctcacctcatcggatttatcctgaggaagaacctcggacagcacccggtcgattcccacctcttttgcaatggcctctgcggtcctcttattgtctccggtgatcatagctacttctatgcccatcttatggagctgttcaatcgctgcccggctggattccttcacaacgtcagcaacagctacaataccggccagattgccgttaatggccacatacataggcgtttttccttctcctgccagctggtcagacgcttcttccattcctgttaaggagatgtcccgttcaaccatcagcttccggtttcccgcaaggatatcttccccgttgattttcgcttcaataccccgtccggtgagagactcaaaattctccgccgccaataaggtaagtcctgcatcttccgcaccgtggacaattgcctggccaagggggtgctcagagcctttttcagcagaagccgtaagctgcagcagcagctctttagaaagcccttctgcggtcacaacatcggtcactgttggttttccttcggtaatggttcctgttttatcaaatacaatggtgctgatcttatgggccgtttcaagagcttctccgcccttgatcaaaatgccgttttccgcaccctttcctgttcccaccatgatggcagtgggtgttgcaagacccagggcacaggggcaggcgatgaccagaactgagataaatatggtaagggcaaacttcaagtctccggctgtgccgatataccaggcaataccggaaagaagagcgatcacacaaactacgggaacgaaatagccggaaacaatatcagccatctgtgcgatgggtgcctttgacccttgcgcatcctccaccagtttgatgatctgagccagggcggtgtcactgccgatcttctccgctctgaaccggatggttcctgttgtatttaaagatgcggcataaacctgatctccttcttttttatccaccggcatgctttcaccggtaagcatggattcatcaatggcagtgtggccgcctaacacggtcccgtctacgggaattttttcaccaggctttactaaaatcatatcaccgatttctacttcgtcaataggaatttccttttccacaccgtcttccacaataattgcagtcttaggcgcaagacccatgagctttttaatagcctcactggttctgccctttgaaacagcctctaaggattttcccagcaggatcagggtgatgatgactcccgccgtttcaaaatacagagaatccactgccatgaaatgaccttctgcaatctggaacatgttgtagatgctgtaaagaacagcagccgtggttcctacagcgatcagggaatccatgttcggacttctctggaacagggctttaaaaccaatggtataaaatttataaccaacgcctatgaccggagccaccagcaaaagctctaccatagcatagattaaggggtactccatgggagcgatccctgccgggaagggcagctgaatgaacttgatcatgggtgccatggcaacgtagagaagtggcacggaaaacactgctgacacaatgaacttcgtccaaagagtcttgatctcccgctgcttgcgggcccggtcctcatccgctgcatctgccttatttgcctccagggccttatatcctgccttttcaatagctgcccgtatggctgacatccggatcttctggggatcataagtaaccgtagctttttccgttgcaaaattcaccgatgcgcttaccacaccttccagctttcctacagccttttccacacgctgggcacaggccgcgcaagtcattccgccgatgggtatggttacattggcattttctgatttttcaaccacctcatacccgatctttgacacggctgccttaatggcggaaagctcaagagcactgctgtcatattccacaaaaagcttttcacttgccaggtttacagtggcctgactgatgccggaaagcttccgtactgtcttttcaatcctctgtgcacaggctgcacaggtcatgcctcttatatttaaaatttgactttccatttgattcacctcactatttttttgctgccacttccttaaggcgtcccctccgtcgtcggcaatcactgctactttactaatttttccatggtctccaaaaatatgccattctgttatcttgaatttttcgagcactcatgttattattatggcagtaattgcgaaaattgcaagtatgcacttttttgttatatagtacccaaaatgatactaaaggaggaacctatcaatgaaccgagactgtacaaattatcattgcccggtggatgccacattagatatgatcggaggaaagtacaaggccctcatcttatggcacttgatcagcaataccctccggtttggagagttgcgaaagctcatccccaggccacgcccaaaatgctcacccagcagctgcgggaactggaagaagatcatctgatcacccgtaccgtgtatccggtggtgccgccaaaagtggagtatgccctgtctgatttaggaaacagcatccgccctattctggaggccatgtataactggggagcagactacttaagccagaatggcattacagtatgctgctccatgaagtttccttcttaagatttttaataagtagacttccagtttgcaaatatctccttggattccttgaggaaatcattagagatcgtgatggactcgtctgtcacggtcttatcctcgtcaaatatgggccagggattgcagcctcctgcttccacttccacccggctcataggaaagcggttcccgcagttctggcaaaccagaacatctttctcctgcttatagtatcctcttcctgagtcataacatacctgacaggtgttaaacgccgtccggatggttccatccggggccttgaccgcaatgacctccatcttggtgccgtctacatcaacaggataaaattgagccgtacttgaaatatcttttacaggaatcacaagggcttctccggtcccttccttttggctgctttctgccgatgccggtgccggttctgtcttctccaccttttcctttggcccgcaggcggtcagagctgcggcagctatcacaaacaacgccagcctcattggaaacggactgggtttccctccgtttttcttatcatatccattctgaaatttccgtaacataaaatacctcctgaatttaaactctgttaatcctttttatttttgtctcccataaagaacattgctataataatacctaaagccggaaggatacaatgccagtgacttaacaataaactcatgaatcagatctcctttcctttttacccgcagcaggaaccgcctgctccctggaaggtatcctcgggccagatcatggttttaaagctgcttatttcttttttaatcccatccatatctatgttatttaaatcatccacaaccttgatatacccataaaaggcattgtctcctgtggaaaaatcaaagcttcccgccggtgtaaaatacaggttgttttctcccttttcaagtggaagctgggttgcaaaatccggaacaagaagctccgttccgtaggtggaatcagaagtactgtcaatgatattccattccacatccaccccggatttcaccactgccgctgccggcttaaagccttcatccgtaagctccatggtgatcctctgaatggtgtttccatactcatccgcagcgtcttccgctacagcaatttcatctgttggaatcgtatagccggctgccaccggctcttccggtgcatattgttttaatacgccctcttcatcagagcctgcactgtttcctgtatctccttcttccgtcacatagatggatccgcgtatcatccccatccagcagctgtatgagatctttcctgttttttcaggggtaaattcaataacattctcccggttttaaaagaatattcaatgccaagatcccggatgatgatccggttgttgcatccgtttatgcttcccttgggtgcatcaatgatccattttaccggaatccctttctggacactgatatttggatatcttcccggagaaagggtgctgtttatgatctgcactccgtcttctatttttgtatcagcctttttctcctgctctcctgcagcataggcgctgcctccgccgctggagaatatatccggcgcctgaaagcccgataggtttaacccctgggaaaacatggacatgccaagcaccaccaccagcacagcccccactgtcatgaccttgcctgtaaacttttttccaagggcagaggaaagggcaccaagtccgaacataaggggtacggtacccaggctgaataagaacatggacagcgcgccggaaaaaggatttcctgtagacagtgcataaatctgcatcgcctgtaatggtccgcagggcataaggccgtttaacaggcctacgatcagagggctgttgttttttgatttttccttatcaatttttcttgcaaaaatttggggcattcttggattcagcctgcgaagccatgggaaaattcccagcatgtttatgcccataatgaccataaagataccggcaagcagctttaaaactccctgaagggtattggagaacgtaaccacagagcctaaggctcctaccagaaagcctactgcagtataagaaatcacccgtcccaggttataaagaaaagtcggcctgaaggtggaaaaacggcttttttccggacccccttctccgctgtggggaatacactgggacaggttgatgccgccgcacatggccacacaatgaacagatgtaacaaggccgatgacaaacagcattccatagcccatcttttcatctgcaagctggctggggacaagcagatttagaagtccgaactgctggatcagcatgtacagggagacaatgatgagcagaatccctatggcccggctggtatccggccccttttgttcatgctctgttaatacctggtaatccagaccttcaatgatccctacaatacttttatacgaaataatatctgtatcaaaagtaatggcagcagttccggtactgtagctcacttccgctttttcgattccagccgtgtttctcagttttttttcaattttattttgacagcttatgcaggtcatcccgccgattcgtatctttttggttcttacagcagatcccatcgtctgtcctcctttttaatttctgaaaccaagaataacagggcaatttgtagaagttgtgtagataaggtttttttcacacaaaatccacatataatcctcatgcatctattcaccgttgaatggaatggctaaaaaagaaaaacacacatgcaaatacgaaaaaacacgtgtatatcgttctttcaaatgatatacacgtgttatttatgtattaaaatcactgcgcctgattaagccttatatcaagacagacatctccgatggaagtcgtcacgcagcaggccgtatggaatgcatattctccgttttcatcaggatcccgaagaaccggaggaaggatatcacaggtcaaatcctcgcctgcaagcatggtaaggacatttccgctgataatgttggctatttcagatacggcagaagtaacaaaatcatccactgaatcaaattccattccgctcataatatttacaatgccaagagatgtctcatgagggagccggtaaaccacttcccccttaaggtctccgataaagccgatggaaacatccaattcctcttcacatgcaaaggagtccgccgggtggtcggaaacatcattaagctcaagcatcagcttaaatacattcctggttgcttctaaaaaagggccgtaaaggtcagtcattctcagctacccctttgaaattgcataggaggcaatgcgctgatcttccgccgccacatggttgatgagccaggccacaagcctgcctgcaaacttctgcatcagctgctcatcataaccgctgcgctcatactcttccgttaccgcaagaacataattcaccatatccctatggatcttcttatgctcttctctgcccggataaccgattttctcctggtatgcttcctcatcacggaaatgctctacaacatatgcattcataaattccagggtttcattcacctttcctactttctcatcccaggtagcagatgagcgcagcactttcataaaaacctccacccgctgaaacagttccatatgctgtacatcaatcgatggaactcccagctcatacttgtccttccaaagcattggttatcctgcctttctataagtatataccggcttcatgaagccggtataccttttatcatttgtatttagaatacaaaaccgggatgttctcaggctttgctcctgcctgtattatatagcaatatttgtatacctgtcaagaaaaccgctgctcaaattgcaccagggatgtgatgagttcttcgcatatccggtccacacttttatgatccgtttctatgatgatatcagccgccttttcataaaaatccttacgttttgccataagctcttttatgaattccacattcatatttccatttaaaatcggacgcccgccatcaccctttacccgttccaatatggactcaggactggcggtcagaagcacgatgcggcttccttttttgagatttttcacattttcttcccgcattaccgcaccgcctccgcaggaaataatggtctggcggcagttttgcagactgaggatcgcactgctttcgcagttcctgaagtattcctctccgtattgtgcaaagatatccttaataggcatcttctggtcttccacgatcatggcatccacatccacctcattcatggccagcacatcctttaaatatttggataccgtactttttcctgttcccataaacccgatcaatgcgatgttatgatcaatcaggcttttgctttgtacacacttgctttcctcgcggatctgtttaaatatcctcaatagttcggcacagtaaggatgttctccgatctctgcaagcagactgtcatgccggacagcttcctcttccggcaaaaagatgggcagcccgtgttcctttttgtattccatgatctccgccgcgcagccaaggcgctgcatcagaagctttaaaagctccgtatcacagcggtccaaatcttttcttacttcattcagctctctcatattgtctctccatattttggctcttaataaatcaaggggatatcttttgttccctgcattttttacattatacaaaacatggaggcaggctgtaaagcaattctttccgtttctttttatcagcccaaacgggagccggtaaaattataatcttcctttaaaagccggaacctgctcacttcctgttgaagcatctgcgcctgggcagccagttcttcgctggaagaggagctttcttctgcggtggcagcgttattctggacaacggaagacacctgggataaaccctggttgatctgctctattgcctgcacctgatagaaagaggattcttctatttccttgatagccttttctacaagcactgccttttctgctacctcctgaagtacttttgcggtttcatctgccagccgttccccttctgcaacgcttgtaacagaacgtgtgattaaatcagcggtctgctttgccgcttccgcagatttaccggcaaggctcctgacctcatcagctacaaccgcaaagcctttgccggcttctcctgcgcgggcggattcaacagcagcatttagggcaagaatgtttgtctggaaggcaatgtcttcaattacctttgtaatgcttgatatcttatcagaagctgatccgatttccttcattgccatattaagcttccgcatgtattcgttgctctcattcactcctgctccggcctgcccaacatattctgcagccttttgcacattttctgcattttgttccgtctgccctgccacactggagacagaggcattcagttcctcaatcgtagccgcctgctcggctgtgccggaggctaaagcctgtgctgcagcggaaacctgttctgctcccgcattgacctgttcagaggaagagcttatcaataagagggtctggttcaaatcccttctgatcttctgcagtgcaagcccaaggatatcctgctcagaacgtaggggcacttccctggtaaaatcgccgttgctgatcctgtccgcagcatcaacctgctttccaatgctttcgatcattttggtgaaggcatttgcaagctgaccgatttcatcctttgaatcaatatcactaagcgctacatccacatggcctaatgcaatccggtcggcagcatccactacctggccgatcggccggctgatcatctttgaaatttttgaccctaaaattatggctacaccggctcccaacacaataaaaagaaccagaacaacagtcagccacaatgcagtcgcgttattgacttcatttgtctctccggcttcagccatccgagtgtctatgagcatgttgaaattatcaaacattttctgtatattatttgtttcctcatagagcgcgtcccatgcggcagttccatccccggcatttgccacttccaggcacttttctactgccggtttaaaagcattgttaaacagggaaattgtctcgtccaacaaggcaagagaatcagggctggtaatggtctcccggtaagacgccgtgctggcaagaaacctctctgatccaagatcaaagctttgctccagctcatcaagcttctgggcatctccggcatagatcaccatggctctggaatccacccggaactgatacaggctttcaaccgcagccatcagatctttcattggtgctgtctgttctttatacaagtaagtatccatttggctgatcctggccagtccggcaatccctgcgcctcctaccaacagcataataagggtcaggctcaaaaaccctgtcagcaatttccgtgaaatactgaaatctttaaagcttttcattttacttcctcccagttctcttttgtattattaaaaatcggacaatctgcttccccttcccggagtgcggctctatccttattacatataaaaccatctttaaaccaattaagccataataacaatctgtaaaaagcaaaactatatgtcttttttttcacaataatctcgtacacgtttgtcctcctcggcaatgccatcttcatttcagggcctaataaccctgtataggataatgtattgatcctgaataaaaaaagtgcatggagagggccgttgataccgtggagtgcagaacagattcgcagtatatttggtactgcggaaaaggagaaataatgggatatttacgtggtattataagtcattgacgggaagactgacggctttaaattccgacacagtgatttacagcaatgcagtcccctgcccttggattataatcttattcctgaaaaagctaagaggcgattcatttctttattcctccaagccaatgagaacacatatagctccgtcaaatgacgattttgttgacggctgatatatgaattttcagaaaaatgtttctgatctagtaggataattcatgaaaaaccgctttttaatgttgcaattattagtttacttgatatttgacaaataatattttcttgttgtataatgaatattgtcgaaatatacatataattgtaaacgcagtaccaaatatactgcgtcattttatctaatttattatacaaatagaacaaatttcttatactatactttactattttagtatagtttttatgtattccagaatctgtctgccgtatctgaccaaagaacacactcaaaaaaccggccaggactttacaagcccctggccggacggctttatattcaggtgatttctattccgatatcagtctcttttctccggtgatctcctggatcggcttgatatcctgggtcacctccagaacgccaagatattctccttcatggcttcttaccgcataataacggatcaaaatatattttccggccatttgaatccaaaagtcttcctggtccttactgccggttttaaaatcttcaacaatctgttcaacgatgtggacacttgccggcggatggcagttggagacatttctgccgataatggcttttgttcttgggaaggttctctcttttccctctgaaaaatactttaccacgtcatccttatttacaaaggtaatgtcaaaggggagcgcatttaacatggccgtcagctcctccacctcaaattctcctgaagggagtttaataaggccggcctcttctttcttctccgtcttttctttgttcttgtcctctgcggcaggattccactggggcacacggtcaatgataaagcctatttccttgctttcatcagcaattgtcttccattcttcctgggtcagctgctctagaagcatggggaccatgatattttcttctttaaatatcatctcaatgatcttatccagcaatttttctattttctgcaccagggtttcgttaagctccccagccctatgaagcatctccgcggtttctttcacttgccccctgatttcatcgtccactccccacatgacctttgggggtgcggtgattccgtatttttccatatacgggaacagcagattttccttttttccgtaatgaacggataaatcctttaactgatttacaccttctttaacctttgaaaacgcctccttgccgctcatccttgtcaggggcaaataaggacggatttcgtcttcaacgatttgagcaattttttcattttctttgaccaatacattcaaggggtgtccgggaatcaaggttggatcagacgggtggtggatttcctcaatggaacctttaaaaaccgcagcgtgaacatcacaaagcttctgcacctcttccaccggcaggccttccgaaataagggcggtttcagccgcagaaatttcagaggcagacacgccatggaacgcctcttcaaacagcttcttgacttcttccaccgactttccttcatgtagttttttaatgatttcctttattgcattttgccgcatttcacgattgttaatatattcactcataaaattcctccttatcaaacagaaaacctatttgtcttcttcctgcggactttatcctctcccatttgaacaaaaaacgcccccgtctgattgtcatttccctcagaaggaggcgctcttcctgattattctactgttataaccgaaacaggacagccttcctgagcttccactgctgtttgctccgaagattccggcacttcatcaacatatgcttctgcaggtccgtcatcccccattcggaacacctccggacagattgatgcacacaatccacattcaatacaaccctctctatctaccgttgctttcatatcaacaactcctttcccaaagatatctttattgttggtaatttcttcacaaattatccatttccaaagatatgttttatttttttcagaataccattgccatggttttatgtcagttgtaattacaacattttccaattttttgataaaagtttacaaaatacatgatatgctattataattgtggaagtatagaaagaaatgtaactcattttttgataacagtaaaatccaaaacaaaacgattttatattaaataagggggtaaaaatgaatgaacatatggaatgagatgtataacagggctaaacaggttcaaaatccaagaaccatttctccgtttattgatgcgggcggagttgccgctgctatattaacagcaaataacaatatttttgtcggagtttgcattgataccagttcttcccttggaatgtgcgcggaacgcaatgcaattgcaaatatgataacccatggggaaagtaaaataaccaaagttcttgcaattatgcctgacggaaaaatcgggcccccgtgcggggcctgcagagaatttatgatgcagctggataaggacagcaaagacattgacgtcctgatggataaggatacgttagagacagtgaagcttggcgatttatgtcccaattggtggacagacagccgtttcagccagctttaattcaatatgaattatgcccggaagccgataaagcaggaaggctgcgaaccaactcccgtcagttatgcagccttccctttttattgcgccggtatccggctattatgcattcatgaataattcgatatcatcttctaccgtgccgattcctgcaattccaaatgtttcaacaagaactttggcaacatttggagataagaatcctggtaatgtgggtcctaaatgaatgttcttcactcctaagtaaagcagcgcaagaagcacgataactgctttctgctcataccatgcgatgttataagcgataggaagcttattaacatcatcaaggccgaatacttcttttaatttcagcgcgatcactgccagggagtaggagtcattacactgtcctgcatccagaactcttgggattccgccgatgtcgcccagctccagcttgttgtatctgtattttgcacagcctgccgtaagaatgatggtatcctttggaagctgctttgcaaattccgtatagtactctctggatttcattctgccgtcgcagcctgccataacaaagaactttttaatagctcctgattttacggcatcaactactttatcagcaagtgccagcacctgattgtgggcaaaaccgcctacaatgctgcctgtttcgatctcatcaggagaaggaagcttctttgccatttcgatgatggcagaaaaatctttctttccgttttcgtctgcaggaatattaggacagcccgggaagcctgccgcacctgttgtaaaaattctttctgcaacttccggtgtttttggaggaacgatacagtttgtggtaaacagaatcggtccgtgaaaggactcaaattcgccaacctgcatccaccaggagtttccgtagtttcctacaaagttgtcatatttcttaaatgcaggataataatgggcaggaagcatttctccatgggtgtaaacatccacacctgtcccctttgtctgctctaaaagctgctccatatctgttaaatcatggccggaaatgagaatggccggattctttctgacgccgatattaacggaagtgatttccggatttccgtagcgggaggtattggcctcatcaagaagagccattccctttactccgtattcaccggtctttaaagtcaaagcaaccagatcatcagctgtaaggctgtcgtcaagagttgcagcaagtccttcgtacataaaggaataaatggaaacatcctctttcccaatattgaatgcatgctctgtgtaagcggccagacccttgattccgtagatgatcagttctcttaaagaacggacatcttcattttccgtagcaagaaccccaactttggaagccttggaaagcatggattctctggaatccacagtaaatactgcggcatcctggtttccgttgtaacccgtatcttttgcaagctggtctcttaaaccaagaacctttacgatctgcttttcaattgcatccgcatcaaagttagcgtttgtgatcgtaataaagaggcttgtcagcacctcatgattgattgtgttgatccctgaaacatcggtttttgtctttacaacaatttcagaaataccctttaccgcataaatgagcagatcctgaagcttggcgacctcctcattcttaccacagacacccttaatggtacagcctgtgtttttagctgtctcctgacactgatagcaaaacatgctcatattccattacctcctaattgtatgttttctatgcatagcaccaattttttagtgctcttgctttctttatagaggataccattgccaggagaacatgtctgttgttattacaacgaactcaaacttttttaattatttttatcaaaatcaggattaacagcagagcatttttattcataggacgtaattctttagacaagggaataatcccggtcccctttactgcctgattgggttaaacgagacgaaaaaggctgtaccagcaatttgttttaccaaaatgctgatacagcccatcatgccatggaatcagaaactttttcgcaccaattccccggagcggtcttatcgttggtccatgcaaacctttatgaattttcccatgatcagaatataactaaatacaaaaacaacgcctgcagccatcaaaggccattttttctttttctccgggatcatcaatccaaccatgattcctactgcacacaggcatatttttaataatgcaaaatcttttacactgcatttctggacaaatacatcggcacactcacacatccctttcatccacactgtctcctttcaaatttttccctggttcttttcagtcacgttctgtttacttgattcaaagttagtatacgcttttggaaaaatattattatattcaaaaagaaaatccatgttcatattttgatgccacgaaacttatccggaactgaccaccggaaaattctcataagctttttacctccaatctattgacagatcattatcaacctgctatcatgttcattaattgataaattattccatttttgaacaaaggagtgtgctatgcaggcaattattctggccgccggaatgggacggcgtttaaaaaagctaactgaaaaccagccaaaatgcatgatttccgtaaatggcattcctatgatcgaacgcatgctaaagcagctggatcattgccgtttgaacaggatcatcatagtcaccggccacaagggggaagagcttcaatcctttgtatcctctctccctctctccactccggtcatgtacattgacaatcctgtgtacaaaacaacaaacaatatttactccctttatcttgcaaaggaccagcttcttttggatgataccattttgctggaatcagatttgatttttgagcaggaggtgctgaaccagatcatcagtgacccctatcccaatctggctcttgtggcccattttgaaagctggatggatgggacggtggtcctccttgatgagcaggacaatattatgaaattcctcacacggaaagatttccgtttcgaagacattcattcctattataaaaccgtcaacatttataaattcagccgcaatttttccactacccactatgtgccctttctggaagcctacagtaaggccctgggtaacaatgaatattatgaacaggtattaaaggtcatttctcttttggatgaccacgatttaaaagccaccaggctggaaaacggcttctggtatgaaatagacgatgagcaggatttagatattgcggaatctatttttacggattcccaaagcagattgtcccggttatcaaagcgtttcggcggctactggcggtatcccggacttctggatttttgttacctggtcaatccctattttccaaacagccggttcatgggagagatcaaggccagctttgaaattcttaccaccagctatccctccggccttgatgtcaataacctgcttgccgcaaaatcccttggcctggacagaaaccaggtcctcaccggaaacggagcagccgaattaatcaagcccttgatccgcagctttaaacatgccgtgggcgttgtgcgcccttcctttgaagaatatggaatctgttctcagaatgcgttttatttttccgtttcaactcctgattatacatataccgcccaggatattatggacttttacaaagataaggaactggaggccctggttctcgtaaacccggataatcccacgggaaattaccttccaaagcaggacgttttatctcttgtccaatactgtaaggcaagaaatatcacattcattctggatgaatcctttattgacttttcctctgcagaggaatcgccctcccttatgagtcaggaaatattggatgagtacaagaacctggtgcttattaagagcatttcaaaatcctacggagtccccggactgaggctggggcttcttaccagcagcgacccggaaattataaatcaggtgcgggaagaactgcccatttggaacatcaactctctggctgagtattttcttcagatatttgaaaaataccaatcagactaccatgatgctttggagcattttaaaaggacaagagaaaaattataccagtccctttcctccatcaggcagctgaagctttacccttctcaggccaatttcatcatgtgtgaaatcaccgatggctgttctgccggccagatcgcagaactcctgttaaaccgttacaacattctggtaaaggatctgtcccataagccgggaatggaaggcagggagtttatccgcattgcagtcaggacagaagcagacaacgaacgtctggctgatgcgctgaaacatatattacgttagtcaaataccctgcagtaagctgcgggcacgaaaattgaaggaggcagcaactatgaatacacaggaaatatcaaaggaaacctggaaacagatctggactcggaaaggccgggcagacagctccgttacggatcttctggcatacgacggctatgaggccaccaaggtggatatggaagaggtggcccgccagatcaccaaacggctggatatacagaaaaacgacaaagtccttgaagtaggctgcggcgcaggtgccctggcccaatatctggactgtgattacgtaggcattgactattctcctaccctggttcaaaagcatatccagtttttacagaattcggtcctgacaggcgaagccgcggatctgccgtttaaggataattcctttgacaaggtgatctgctacggcgtttacctctattttgaaaataaagagtatgcggaaaaagcaacaaaagagctgcttcgtgttgcaaaaaaaggtgtgctgatcggagaaatcccatgcgctctcaccgggaagagcacttattattttctaagaaagaattccgtgactgggatatcagcgatggtttttatgacccttatagaaatgaccggtttaatgcggtttatattttctcttaaagaatatgctgcgacagctttgttccggaaacatgcagagagactaacccagataaggttagtctctctttctattctgccgtcatttgagccatctccatgatctcctcataaagggctgtagccgcatcctcctggtaaccgtacatcaggagcacgtcaaggacatagggggaaaaggaaattcccagcagttctccggcaaaagccatgcctgcaatctcacccaggcacaccagcctggatctattggaaaacgggggcttccaaagttccaccttttctgtcttagtataaatgaaatcctccttgcggtattctacccagtgaaagatctcatgggcaaggaggagactccggacatcagcatgttccagaagtgcaccaaggcaatggtcctcaatgagcctttcggcccgttccaccccatccatgaagatggtcacctcatccggctccacatactgggcaaagatcacatggccgcctcctgagggtgtatccggggtgaataccttaagtcccagtttactggctatgacgtccggatcttttgtgttatgctcctcttttaaaagagcagcctcctctcttccgcaacgccctgcctccaggatatattggagtttttgttcccggtcaaactttccttccaaaggttctctggaccatgcatacatgccaaactctgtttcagacagctttgccatatcctccatcatgggatggagagggaggatcctgcccggttcctccagcccaaagtcaggtacctgctgctttccaagcaatccctgaaccagcctttttgcgccttccctgttcatgggcatcactctcctttcccattcctgccttatgatctgcttccgttattctttataactgattctttgctccaacaacgatgatgtcatctcctgtatcgatcatctgcatctctacatccatcagcatcaggatctgttccagttccccggttccgttaaagtccatgacacgggcacctacacagagatagtaatcgggccgcagtatggcatcggctttaaataatgccagttcttcccacatcctggataccacgctccggtaagaggaggctttggcaagcactacctttccgtcggttctctgaactttgataaagccctttttgtccagaatccggagaggctgctttccttttgcctccatattatatacatagaaatttgacgtctggcccacaagggtgatatcggcaggtttggcacgcatatcttctgctgccagggtccttgcctctgcttctgtacattcttttaataagtccgttgtctttacctctgtggagcctaatgcaatggctgtcagtttggaggtctgcgggtcgatttcaatgtggacttctaccgtatcaggagacgcgccgctttccaccgctttatcaatggcctctctcttaatgcttttaatgtcctctggtgttggatttggaaccacccgctccaccacgtcccgcaccatggcaagggctacgccgatggaggagattacctccgcattctcaggcacactgtatttgatgttcatcttctccgcgcagaacccgatcagggaggtggctcctccgcctactcccaccagggatatctggtcatgctccagacggtatttatcagccagttccatgatgatgggctggatcttctcataagcccttgtcaggatctgttttgccacctcttccaccgtcactcccagatagtccgcaaccggctgcatggcttttctggccgcattgacatttccgtaggagaaatcctttggagttaccagaccaaggacattagctgcacagctgtttgtgagggtgatcctctttccgcttccaaggcggatggccacataatcatcaggatcaccttcccttggagagaaaaattccagcttgggatcaacgatttccgattcatcggtaaataccgcataatccatgcctgcgatatgggcggaacgaggtcccacatcatgaacgccgcttttattcacccggatcatgcttcctcctgccacacccaggacccgcacatccagggaactgatgtaagtcctgtgacctcccacgatggaataatcaatggccggacgcccgtttttaatgacacctatgttggtggtggttccgcccacctcaaagtaaacgccgttggaagcccttaaatacatgagagaacccataacactggccgccgggccggacagcatggtcaggaccggccgttttttcatctcattgatttccatgacgccgccgtccccgcgcatgatcataagcggcacttctacgcccgctttccgtacgctttcctccgtggagtttgccgtatttaacatcttaggcaaaatacttgcgttgattgctgctgtcctggtccttctggtaagcccatacagcttggtgatatcggaagccagcgttgtttccattcccatctcatcatgggcgatttcaaagacaaactgctctccgccgatgtcatccactccgtatgtatccgaagcgaccagcacctgggcaccttctgtctttaactcctccacggcttttttcaccgtgacttcatccacatccatatccttgatataggagtttttgatcgtaattttccttcctgaacccagatcaatgtcctttaacctggtctggcatctggataaaaagccttccagacctgttggtcccattccgatcactcctactgttgcaacatcccttcgatcagggcattggttgcctgggtggtgctgtgggccacaaaaatcacatcctcaggagcaatgtcattttccctcaaacagttctgaaacgcagccacaacacctgccgccacgccgctgcggtcatcatgagttgtcttaacggaggatttaccgattatttcatgtgttgcattatctatggcaactgcctttgtatgggtccctcctacatcgatccccattcttaccaatctttttcccatgtgttttctccctccattaaccgaacatgataaatgtaatgatctgcaggataatacagatgatccagccgcagacaatgcttatttttaagaaatcctttgtggaaaccttggcataactgattccccacacgatccaggactgggtgatgcagcaggaaacgttcataactgttgtggaagcgatcataaggggagcaaggaatgttgtggaaaagccgattccctttaatatccccagggtcgcagcgccgcagccatacagggtaaagggtccgcggaacagtccaagaggcgcaagcacacagaatatgatggtaataaacaaggtgctgtttggaatgatgtttcccagcaacgcattaaaatatggaatacacagctctgcagccttgttaaacatgggcaccatcagcaaaaagccgaccaaaggagccgtatccaccacgccgtcaaagaaatccttattaaaggtacggcatgcggtcctgaaatccttaagcttcccgcatacaaacagagcataaaaaccgccgatcaaaaagcccataataattggaaccttaaatgcgatcagcaaaaaaacagggataaacggcgtcagcagagatctgcccggcgcaaaatcaattttctgtctcataggccttctggctgcccatggatggacggttttcttttttctcataaagaacagcaccagacagatggtgaaaacaagctggacagtcagggcaatcccgccccaccgcacatactggtcataagggtaaaccgtctttccctctgcatccaggaaaaatgccgtatactgtccgaacaataccggatttaagaacatccccgccccgatgctcagcatgaaggaaaccacggaaagcaccttgggaattccaagggacatgaggatgggaagaacgataactccgatggcaaccaccgcaccggctccaaacagggaggagaaaatggcagtggtaacgatgcataacaggatgcaggtcacagccggcttatcgcctccaagctctgttgttttacggatcagggtggaggcaatgcctgtttccaaaaggacacgcccgaaccatgcaccaaatactacgttgacaagaacattgccccagccttcggggccgctttgaaataccttggcaaatgcctggatccaggtgatctggatcctgtctgcattggctgccacaaactccggatttgttgcaaatgtattgccaagcattggaagcacggtccagagaattgccatgaccagcatccccatcattaagttcccgccccttgcggcataaaatgccaggccaaagaatgaaaccaaaatcagaatccctatgatatattccattgatttacctctcccttttttacactctttttctcatattatgaacagttccttatctctccagggaatttaaagtttcccatacttcctcaatcacaggaatgccgtttgttaagttatcttctcttgtctttaattccagctcgcctggatagaatacttccccgccttctgcagccggttccgaggacttgatgtcccttaatatctcctccacaatggcatcggtttcctccacggaattgaattttcccggatcaatggcaatcatcacctgggacagacccacttcatctccaaaggtgccgatctttctcacagaatttccattagtcagtaccgttgcgatcaagtccagggcaatggagatcccgcttcccttccaatagcccatgggaaggactctccatgttttttcaatttcagcgggatccgtagtgatgtttccgctggtatcatagccgccgggaaccggaagcttctgtccttttaatcttgcctcttcgatcttaccataggagaactgggataccgcacagtcaatgactgcatgctttccattgcttctgggtattgccatgatgaagggattgtttccgatttttctgtccttaccgccccatgcaggcatgttgggcatggtgttggaccagcagattccaatgcagccagcatcagccgcctgccatccatagcttccgccgcgcatccagtggttattattgcccagggcaacaactcctacgccatattcctttgccagttcacaagcccggtccatagcaagctttgcattcagagggccaaatcccggtgcccatcccaccgctctatggtacccatggaagactcacaggtggctaccgctgttggattgatttctcccttgtccaagtaactgaccactcttgggaaacggtttatgccgtgggagtaaaccccatccagactgtttttggcaaataccgtggcagctccctctgcatgttctggggaaaagcccctgctctctaatatgttctgaaacttctttaataaatcctcgtattgtactctcatgcctttcattctccttttgattcctgtacgccgggtttcttatttttatctttctcttaacgagaaagcgctttcttgatttttattataacattattaacttatatgtcaatataaacctgagcattcttcctaaattagtatattttatacattttattggttttatttttgtaaaatatttatataaaatttgatttcaaaaaagcgttttcctgttttgtaaaaaaaagcggtgcttatcttccaatattcttgaaaaataagcctccgcatacaagaaagcgtttttacttctcttgcttttcctgtctgatttttcttcctgtcatgcggttccccgcacaatcagctccggctggatcgccaggctggaagccgacgtctttccctctaaaacctcctgcaaaagctgggagcatagaccgcccagtaattccggtttattgtcaatggtcgtaagctccggctcacagatcagggaatccggcgaattgttgtaccctgtgatcaccacctgatccggaatcaaatagccacgcttttttaaacctttcatcatgccaatagcagtaatgtcttccccgcatatcacgccggtgaaaccgatgccagaagcacatagagtttccgccgctttcagaccgccttccaggccgaatttgccgggtatcacccgcttttccgcctccggaatatcatggagcttcatggcttctaaaaatccctgacgttttgcccagccgctgtcggtctccatgtcatagacgtaaaccaattcattgtgtccttttttaaacaggtagtccactgcagtcctgattccttttgtgtcatccaccagcaccgaataaaaattaggcaggttcaccttaccgttagccactactacaggaatgtcttttatcttggaagtaatgtcaggataatgaatcagctcattgaacacagaaccaatgagcacaattccgtcaatctgcttttccgacaggatttccatatatttttcacattcttctatggagcctccggtattgcataccgtcacattataccctctgtcgctgaactcctgctcgatcacatagatcatgcgggcataatgagtcactcttacatccacagtcaggatggcaatgcttttcatcgtctttgaaaccagccctcttgcaattgcgctgggtttataatcgtatttcttaagtacctcttccacccgcttttttatctccggattcacatttcccttgttattcagaacacgggaaaccgttgatatggaagtttttgcttctgcagcaatatcatatatattcatcagtgatcacccttgaaagccctttcctaagcttattctatctgattctttcaggtttgtcacggatttttgtaatttttacagaagaattctcctgaatccggccataagatcctgtgaccggctttgaagtaacatgataaattccatcaggaacaattcttttttattgtcatattctcatattcctttggagtataacctgtgatctttttaaatacggcgctgaaatagtattgggtatcaaagccaagcatatcagaaacttcatacatcatatattgatatgttccaatcagctccttcgccttttcaatcttaacctccgttacataatctgaaaaattttttccggtctgttttttaaaaatactgcttaaatgcccctggctgatgttcagcagagaagacatccggcttaaggttatcttttccttataatgctcccggatatattccagaaccagttcaatatacttgtccttcctgctttccttgtaagtctccagcgcctctgccacctggtcccggaaccgttccagccaggcgatcacggcatttaagtcagtcagccggtttaactgccctgccacatccaaaatatagggaaaactctggtcctccctttcttccaaaagaaatgttataaagtaataaagattgctgcatgcatttacggcctgtgaacgggatggcttacactggacaaacagctgaatgatctggttcatgatatgggagaagccgttccggtcattttgacggaccatgcctgtcagttccttctttaaaaaattaatattaaagctgcggcggctgaaactttctttgcaattttccggataaaaaacaatcctcccatgactgtcacaatacgtatcatttataatactcatagcctggtaaagaaggtcctgaatctcctccgcctcccttaccggccggctgaccgcaatggacacaggaacctcaaaatagttcttcatcaccttgcagaacttcatgctcatggtttcagcctgttccttataagcattcattccctccagtgaaagaacaaggataaaaccattctgctcttttcttaagaggcagcttctgtcaaaaaaaccctttaccatttcctgaatgatattttccgcaaaattcataacttttttctgatcagctctggtgtatttctcggaaaatccttcagacccgtaattaaaatgaatcagcattaaaaaaaataccggatattgttcccggatcagcccacataccccttcatccgtctgagtatccgcatcgcaaatcaacatatgtctgaaataattcccaatttgctcgtcctcagttgcttctccgccctccattgcaaacgtcttgcgacggcttagattgcatttatctttggcccttttcaaggccccgatcagtgcagtctcatcaagctccagttttatgaggtaatcaaccgcgcccagacgcaaagcttctttcaccaaggaaatttcctccaggtttgtcaggagaataaaggcggcaggatatccattttccacacatgccttcataaaactgatcccatccatgacgggcatcctgatatctgttatcacaatatccggcttaaggctctccatttgtgcgagagcctgccggccattggaaaccttttttactattttacactgatgctcttcccagttaagaagggaagtgatccctgccagaatcagcggttcgtcgtctacgatcatgattcgatacatatttcatactccaaaggaatttttacggttacctgtatacatacctctgccttggctccccttagcttttccaaagaatttaaaggcttaagtatttcctcttcctgtattcggttccattcttcctcttcggcggcaagacagccttacagtcccagccgcctttttggtaatgcgcttgttatatatttcacattgattttttattgtttaacaaaatagccatactctttcatacactgctctatgtattcctgataagccttttccagccacaaattccttaaaagagtcacagattcctcatactccgcctttccgtagtcctgcttatccaacacttttaagattccctgggaagctccataatccaatacaccggtgctttgccccggctccataaaccgggtctgttctgccagccatgccatttcctgattgtccctgggaaaatcagccgtatcatattctgcttcctcgtattcgatgctgatctctgaccctgcatttacctcattaacgatatctgacggatccttgcctccggcaattcctttctccacaagactccagacctttttcagctcttccggaaattctccggccttcattccgtaatacatatagattccaaccctggctttgcagccctcatcaaacaggaccggatctgcactggcgtaaagctcctgcagctgctctttggaaggcttcagcctttcctccaaaagtttccccttcagttcgtctcttatttccatctgggttctggagatatactccatcagcccatactggccgggaccgtaagaaatacttagagaatactgccgctttttgttctctccctccagagatctttttatgtcctttaaagttatatccgcagggatcccatattgggaagcattcagccgttccgccgtatcccaggcaagacggtccatggccttttgttttaatacttcccttgggatctctccctggactaaagtgtcccagaacccatcttcatttggatccagctgatatttattgtaaaaataagatgcaacttgagcccggcagtcagtttcataaagcgccagatggtcctgggtaatggcatagccacccattttcaccacttcataggaaggcttttgcagccaccgggttcctgccacaaaaaatgcaatgattaaaactgctgccattatcacgttccatctgcgcgctttctgtttcatagtttcctcctgctccttacagtatccttctatattttaccagttcctgagtcagacgtctctccatttcatgaatttcttccatttctgcatcaagatcctggaggacgcgtttcgcttcttcaatcagttgttttaaacctgcttcatccacattactgtaatcttccggattgatattggaagccagatcaataataaagcttaaattctttttaattaccttttctggtacataatcggcttcccagatcagcgacggttttaaggcgccttccttaacagttctggaggaatagatgcctacatagttgtttttggctgccgttggtatgctgatctcaaaggagatttccgtgtccccattgtttttcgctgcatgaacagcttccgtcacatccagcttctgtatcagactctccgatgtcatggcttttgtaaaggaggccgcgggatttgtgcctaaacgggccgggaagctgttgaaggttactgtatttccctcccagccattttccacctgataaatatctgcactggtaaaatccgcacttggcgtatctgtcagctcaaaggccagataaactgcctgagtggtttccggtaactggtccaggctgaacttcataagggactttctggtataattctgggcaccggcatcgtattttacaatcaggctggaggaaccgctgaaatttttatccccgtctgatcccccctgtacataaacatcatccatggcctgtgcggattcctcgccaatctggactttaaccgatgcagtaaaccctgccgtattgtataatccctcaggcaataccagctgtccggttaaatcataggttcccaacacgtccttctggtaatcccctctctcccacagaatatccagggaatgggtgcctccggcattatcataggcttccactgttttgggaagctgcagatctgtgaactttgttccgggagctgccttgatccggtcgaattctccggtaatgccgatgatttcacatgtttcaggggccagcacctttagcgtgatcctgctggttttccccgccagacctgctgtcctcacagccagcttgataaacggagttttttgaagcacttcgatgttgccatcggattccttgacgtctccgcctgtgtagggaagagaaatctcaatggttccattgttctcctgagtgggatccgacacccccaggattgcctcgtccccgttgacctgcatcgttattgaggcggccttatttgatgtaattccagccgcggttgttgttttgttgttccagaaattcactgctgttattcccaatgccgtttctcttacggcatgagcatcctcgctgcactccaaaatttcaatgtcaggtgcttcacagtactgtgccgtttcctccgcatcctttccgggcagaatcacataggaataatctgcattgaccggctttttcccatggtcgaaccagaaagcggcaaactggtttgtctcctgtccctctgtggttccctgggcattccaattgccggtccgcttttcttttaaggccataacatccgcttttcccggaaaataatagcccatatcagagccttccgtatttccttccaggtggatccaggaagcgccggttatttttgatccttttaaagcactttccccaccgtcgttcctgatgtccattgcttccccgtcgatcagcacttcattgcttccatcctcattaagcctccggttgtcaataatggtttccacgtaatttccggtgtcagaggtgatcccgctccccactgctgcgatttcatcgtcaaacataaaccaggacttttttgcatctgtgcctgatctggtgcttccgctgctgcccagggtcttaaaatgcattcctgccccgccgtaattgtccaggctggaaccgcccacccagctgtaaatattcttggtacggtcaccggcgccattggggcgggtcacatattccgtggtggttcctgccaggcgctttggatctacagtagcccaatagccttccccatactgatctctgtcattgttgtagaggtatgtcatgccatcggaaatgttccaggtccgctttccttcatcgttgatcagctcatgcccataggtacggctggaatgcatggataaggcaaaaccgaattccggcataatatgtaccagtttatccatgcccgcaaacagcttgtgaagcacatactcacttctcggctcaatggaagcatcgttcatgatctggtttgctctcattaaggaggcaatatgagtgctgcggctgtaataatagtcttcatcgattcctatgaaatacttcatcatgcggttaaagcggtcctgctgctctggaggcatggcatccctatgagcatcatggcatccatgattcccgccccccttgccttgtcgctggaggtttttcttgtaatgtctcttccggatatcatatccatgcaaaggccgttataaataaatggctcgatcccttcaaataccatatcaaagatcagctgctccccgtgatcctcataggtcaattcaaaatcagtgcctgaaaatacggagaataaaatgctcagcttctcatacagctgagaaccgtatccgcccatataggccagcgcctggtgctggataaaggacccgtcttcatagaatccatctccggtggtcacatattcaaacacggttttatatgcttttttcacatgatccagtttctccctgttgtcggtcaaaagaccggtttgaaccactaccatgcccttatcgatcagatttgcccctgtcatggccggagaacccgggtagccggaagggcggtcgcaacggctggtaaaccggttgactgctgctgcataacggtcaatttgtttcggagtcaggtcctcataaagaatcagggcagtgtttaaaaatgcgatggggcctccgatttcccagtgccaccagtttccaaacaccggtgttttctcatcgctgctgctgtagtgatgttcattcatgaaatccagggccaggatcagttccttttttacttcctcgttctggtacagctggcagccctttgttgcccatgcgaccgccatatcctttaaccggtaaaaggtctcagccacattgccggaatggaccttggcctctgcgccggtccctttgatatagctcatatccagatcgctccaaagattggttctggactcatcacttcccttgatcatggtcttccagcattccccggctttttcatccattccctttatgtaggtgcggaccgcctcattgcctgtatccagttctcctcccagcagggtgccaagccacttttcccttaattcctgaaactggggatcaaccggcttttccgtctcggttgcgcgggtgatgagccttggcccttcctttccttctgcccttgtggaataaaaatcaatcatgttgtcattggccgccacaggacagctgatttcaaaggaaattgccgttttcccttcattcagggcatttttcacgctttcacccacatctgcggttacgatcccatcggatatattgtcctttgcaatcactgcatccgctttgtctctgattcgttccggctttgtattccaggtcaccgtaccagaattccagccgcttttcacctcataaatttccgcagaaacaaaatcttttgcgggattggtattgctgattcctcctgtcagctcaagtacaagatcagcctccttcgattctttttccacccccgatagattaaaggtcataattgttctcctggtataattctgctggccgtcggagaatttgactcttagtttggaagcatcgtaattgctgtactggctgctggttttaccggcatcacttcctccctggagataagcatcctctgtgggaaccgtgactttttcctgggattcaagcgattccatggctgcagacagccccgccgtaagctcattgatccgttctctcaccgttccggtaaataagccggcctcaggagggcccaccttttcgtaagtcaactggctctgatcgtataccttctgaaaaatgcctttcccctcttccataagctccaggactttcccataggactcagccgaataatcaccgggattcagactctttgcttttttatacacagcggggaggccgggaagagccactgttatatcatactccggcagccaggaagaggttttaaagttcctcgccttaaataccacactgtcttcataaatctttacatggtagccgactccggcatcctttactccgttttccgtctcattataggagggaacatcaatcagggtaccgtattcccggtcaatggcttccgcaaccccaaatccgttgtgaatgtggccggacatgtagatcacctgaggatatttggagaatatctcttttactttggagtcctggtttccgaaatccagcagaatattacttctccagtgagtatcctttaatgcattgtgtcccatgacgaaaatcggtttatccgggctggcattttcagccagagtctcatccagccagtttaactgctcctgagaaaggtacatggcatcctttaaaccgttttccgtattgattacaataaaatgataccctcccagccaacggtcaaaatagacggtttccccgttgtttggcatataccttttattcttattcagataaagggcttttgcagttggccagtatgcactgataacagtttcatctttattccagtcagcagaattgtatcctctcacatcgtgattccctaaagtcatgataaccttatcgtcagtgacaggagaatactggtccatgatgttatagatcccattatactgggcctctgttccgctttgtgtaagatcacccagattcagcacccccagggagccgggggcaatgattttcatatcctttaaccctgctataaaatttgcagcattggcatccgacaggttatcggatttaatatggacatcggaaaccacctggaagctgcaaagaggctcactgccttccagaaattcattgtatttttctttcaggctgctgacggctgccatggctgcggatgctgtcattccctccagaccgttctttaccttttctatttctgctttcatctcgttgatctggtccacagggtactgggaacccggcttaatagaagccagctggtcttccatctgttctatggctgccatggctccttccgcttcgtaaatggtctttacggcagatgcttcgatggccttcctatatacccggagttcatcaatgatgcagccgctcatgccataacagcctctgccgtcaccgcctaaaatgaaatccagccccgtatcagctgattttcctttgtgccctgtcatagaaacagacgaatatttttctccatctaaataaactgtcatatcaccatccctgtcaaaaatgcctgctacatgatgccatttgtcatcattggatggtattccttttaattccacccggctgtttcctgttcctgaaaaattcattctcatatccaccttactggtattattaaaattaccaaaggcccagcctgtattgctgccgcttatgtaatctttattggaaaggatggttccgttattttgcccgtgactttctgtcttcatccagaaggacagggaaaaatcttccgttccaaatgttaaatctgtggtttggccgtaattaatatactggtcggctttggtattggcctctcctgctttgcttccgttatccggggaaacgccgtttccccggattcccttgacaaaggccggctggccgtaaatggttccatcatttcctcttccggtctggtcctcagccttgttcccggatatgctgccctcatcaaaggaagagtgcatgaccagcccgtcatttaaaattgtttccagagcattttgatccatatcagctgcaaagctcccgggcaaaggagctgcgtaagcaagatttcccgtcagcacggaacaaatcagtaccaaactgcatatctttttccattttaccttcataagaccgcttccccaaatggtcctgaaagagggaaatccctctttcaggttaaattgattaccggacccaggctccgttttcatctacctgatacccgtccgctgttgtggtattggtacaaagggctcccatcggtctgcttccgctttcccctgtctgatatccccatttgccgtcttctgttttctgccagccggtttccccctgggtaacaggattgaagtaataccagattccatgaatctggacccagcctgttctcatagcgccggattcatcaagataataccaatatccatcggattcttcctttacccagcccgattccatggaaccatccgggctaagcctataccatgtgccctgatccacgatccatccggtctgcattatgccggattcatcaaaccggtaccatttcccgctgatttttgcccattggttggatgcgtaggtcttgtcagcctttaagaatttccatgccgttccattggccttctgccattgtccgcttatgtctgcccccgtcttttgagagaccgtttgagaggatgtgcttcctcctgaactgccggacccgcctccctgagaggtttcctttatcactgttatctggaatacgtccgtgaacaccttaatggcattattgaccgctgcgcggtatgtgatgatcacatcctttacgcccggcacagaagtgctcacatccgatatctcatagccgtttatggtctttaatgagccatcgctgtataccgcagccacttttaagcccaaatgactgatccgttctcctgttttgtattctgtttgaccgggcagtgccataatctttatccctgtgacgatcctggtttctgttcccgaatttccgctgaattccagaccgtcaacagcctctttcaaatagtcgtatgcctggtctaccctgtcctgatcgccctttgtaagagttttatcctttaacacagatttggcctctgaaagagcatcctttaacacctcataggactcctccgtataatcctttttgttcttggattctgctatgagcaccagatccctaagggcagaagtatcaggttttaaattttcttctgcatccagattccagatagcctccatcaagaggacataagcattatgtacttctgattcggttgcctttgtattgatcagtacagaggcagcctggttgaacgccttcataaaacggctttttgccccatcggtcagccggtccaatacgccctgattgatcagatccgccgcttccgtatagagaacaagaagggcattcttatcttccggttcaataatgcttacagttaccgccgcaaacttctgatccgggttttctattgtctcatggctgtttaaatccagatatccgatgcaggtataggaaaataccttttccggtgcataggcattgtccgggaaccagtattcaatgggaatttctgcttctttcccattatccagcagcacagcggccgtctttggaagtcccagttcctcccacggtgttccaaccagctggataataggaggaatatctctgacagagacgactttgtgcagcccttccataacatacacggtacactgaatgggcagctttaccccgtttgccttcccatacaccacaaagcttccctcgctctggtaatttgcagaatcaacgctgttccattccacggtcacgtttttttgttctccatttgagtaattgactgatacggtttccggcagaaccggcatcttcccagacggcgttgatatggaaacagcttctatccccgtttcataaacattgcttaataccatggtgggagccatttttccaccggcctctttggacgcaaaatcaatgccgccgttgtcaccgtttgcatactcaccgaaataatcggttgtcataaggaaggaaaactttgtctgtccttttttgacataagcattctttacccaatcggtcacatccagctccaccatattgtcatggacatcccggatattggcgtatacgatcttttcatcacggatcaccagattatctgaggaagtattgggagcagaattccatgtcaccgttccttcttcccagctatcatccacctcatagaccttgagataaaaatgattgttaatggttttataatctgactctgaaaccggccttgtcatttgcagcctgatggtaatgctggaagcggatttaagcatctgctcatcatcctttaagtcaaagccaatcagtccttttctcgtataggaaggagaattattggcggttttgactttaatgacactgggatcggagcttccatacgctttgtttccatcgctttgctggatataggcatcctttgcagacaccgtttcctttacgcttgttccatccccagctctcctataacagtcacctttgccgtgcatgtttccttcaagcctgagacgattccttctaccgtaatctcaccctcatgggaatactgctccagggtgagggcttcccatgtcacaccaagctccagggtcaaaccacctgcaaattccgctgtaaccgttaccggcagcgccgggtaaattcctgcaaaagtagaaacttcaaccggctcaaaatgttccggtgcatcagctacaattatggtggcaacaacctgattggataatcctggaagaactcccgcaagttccatgactcccgcctccatgcagtcttcctttgtcagctcatcccattgaaccggataatcataggatttgccatccagaatgatttttaaggttgccggcagtttcggcacaactccgggagtggttacgatatgaacttcctccacatcctctgccagttcatcctcactggaatattccaatgcacctatatccacacgccctgcaatggtattgcccataatatcttcagtgggcattccttcgatcctctgtccggcgcggatacatggtgacatttccgtcagcttataaggctccgccagactctggatcctttctttagtgaaatcagaatccatgagatcttccaagtcctccaaaggatactgatagtttgaataatcctttcccgccttataatcaatcagcatgggatccataaatatatttcctttggcctgcaggctctccttatccaaagctgagccggcaatggtatttgcaatgacatccggatagaaacagttgttttctatgacgctgtcctcatgaatggtggaaccctgctctaaaaccgcaaagtcaatggttgctccgtcctttgccagaacaatgttatttttgaaatccacataacaggttcgtttactcttcccgccaaacagagaggtcttaatatcttcaccaaaaacaacaatggtattgttataaattttacccacgccgggccctgcagaggtggtattgtcgtaatggaaggtctgctgctgcagcctgcttcctcccggataggtgcctgcaccgtcattgatgcttatgttataacggaaaatggtatttttctggctggccataaacagcatgaccccgccgccgcagtcgtggcttaaattgtactggaaaatattgtccacattcatcatatcagagtcaaaggcctcaccgtcatcgtatccgtaccggtttccgtaaacctcattgtactgtacggtgacatcatcggcaaacatggtccagcactgggcatagtttaccgctcccctgtcatagccgcaggaagaattcaccatattcccctcgatcagtccgccctttgtttccgtcaaaacgatgccgtcaccaaccacatcttccagataattattgcgtatggtcacattggagtagtttttaaggaattcattctttccccagccggaatcagatatatccgtattgcatttattccggattccttcaatcgccacgttttttacataatttccttcaatgagcacgtcttcaaaggctgcccgccccatggctttggctgtcagattaccgctgtcatcaacggtgaccctgtttccgtctttgtccaggtaatgacccatgacgatgattcctccggaggttttccctcctttaaagttggagttgacatcgtgtacatagcagtttttcacggtgatgtgcttgtatatctttttctggttggaggaatagatcaggatcccggctcgctcgctggtgccgctgtccatggcttcccccatcttatccgtattttctaagttggtcacttccagattgtaaatttcccagtattcttcgttgtaaatcgtcaccgcaccggtgatggaagggccggatgtaccattgccgttaattacgggacggctgccctctccatactgatcaatggtaatcggcgcgccctctctgccgctgcctttgggattcagcgcctggttccagatacaatccgctttcagcagtatcttgtctccaggcagaaaggttttggaattgaccctgtcaaaggtcttccatgcagtttcttctgtctttccgtccccgccgtcattgccgtttttggcatccacgtaatacacagttccctcctccggcacttcctgtgctttttgtgcattggatgcagtggcataactggcgttggaccttgtggccatgttttcatccatgttttcatagctgccttgcggcatttcccggacatcagcaaatccgatcatattcacgggcaaaatgccgatcatcatcactgctgccatcatgccggccgcttttcttttgaaaagctttctgctttttagcataagaaaagatcccccttactttttttacacccttatccgttcttcctgaaaacagcgtcattttccataaaaataacggaataacggcgtttggtttataaaaaaagtatagcatttatggagcagcgtaaaaataaagcatcttaaggtttctagcaatatcttcattttttcccaattcatttattacagaattttacgatatttacattttcatcatcttccctgttaataagacgaaggcaccaaaaaagagtgtgctttgcagactctggcgcaggagtttttatattataagaaatacgttcctttgatataaaaaaacggcatttattttcaaatatccttagaaaataagatgccgtatcattttaaaagcatttttatcattcgtatctgtctctattgtaaactcactgctgcactgggaggggctccccgtacaatcagttcccggcgttcccatttctgcagacagtccaccggggtccttcttctccgtacccgtcacggacaaagccgttgtttagcaggaccttttgggatatatcattgcccggctccgtttgtgctgagacacattggacacccttttgttccagtgcccatttcaccataccgtttacagcttctgtcgcgtaacccttccgccggtatgcctcatctatcccatatccgatttctacggttccttctgcatcaggtgtgcctttgaaaccaattccgcctattatggatccggatgccaggctgattttccactccgagccccattcttcctgccctggcaactgtcccatggtttctaacatgtctttgtatgcctttttcatctccctgtccacctctttttcataaagtatggtgagttcttccatgctttggggagtcatacaaagtctttttgttgaaacaacgttttttttcatgcggtcatcagctgaaaaacagctccttcacttcctttacaggcatctcctggcccgtataaagcttaaatgcctcagccccctgccatacaagcattccctgaccgtcaatgcatgtgcagccggcagcctttgcctctcttaacatcttcgtttcctttggattataaaccgcatccaccacaaccaggcccggacggaacatggcagcatcctttacaacgctttcattatccatgggtttcatgccgacaatggtggcatttgccagaatatcgctggtggctatctcttccctcatcttttcaatatcagcaatatcaaacacattgacaatgcattccggcttttcctgcctgattttttctgcggtatttaaggttctttcaaagaacgcatcctttatattaaagatggagatttctctggcaccctccagagcacactgtacctggatcgcagctgctgctccgcctccgccgcagacaaggatcttcttacctgcaatttccactccatgatcccggagattatccacaaagccctggccatcggtaatatggccgatcagccttccttcttcatttactatggtattgaccgcaccgatgatgcgggcggcaggggacagctcatccatgtatttcacggcttcgttcttacatggcatggtcacgttgcagcctctcatacggagtgtctttacggcctcaatggccttttccacctcatccaccttgatatcaaatgcaagatatgcgtaatccagacccagcttttcaaaacaataattatacatggccggtgaaccggagtgtcctaccggcgagccaatcaaacctaataaacctgtttttcctgaaattcttttttccattgttttttctcccttccactctttcgcccatcttctcaggacagggcccactccgttttaccggttgtaaaggcatgcccgtattaccgataagatacacttcttttaccggcttgtcaatattttctcctgacagttcaaaagacggaaccctttttctcttgttcacggtcttgatcagatgacggcctttattaaaaaccatacaacaggcaccaataaagacggaagcatatttaaggccttgcagtccttgatttttaatatagaaaggccggaactaaagatcagaaaaccgcccacaagagaaatctcagttaacagctggggagttaaaaaagcggaaaggctgccggaaaaaagatagatgcttccctgccacaaaaataataccactgcagataaggcgatcccaatcccataggtggaagccaggaccatggacgtcacaaagtccagagttgcatttgtaaacagataggtattgtttccgtaaagtgcgctttccattggacccagaatcgaaagcgtcccgatacaaaacagcaggatcgccgtagacagcccctggcctaaatctccttttgaaaaacgggccacaaccctgtcaaacttgtccatcagatttaacctggtgccaaggagacttcctgccgcaaggctgatgataaacagcacgggatagctgctctttggcatattctgcacgactgcattgatgcccagaccgcaggcggaaagacccatggcgttatataatgcattctggtatttgtcctcgatcccttttttcacacaagttcctatgacactgccggtcagaatcgcagctgtatttacaatggttcctatcacggttgtccttcctccctgaaacgaaatgtattccataaatttcaagcttttcctatgaaaaccagtataccagattccacccattttgcaagacattgtgaaaaacctgaccctgtcctcttggtttaagccacctctcttacataaagaataccgggcagctgccccatttcttcgatgattttcgtatgatttaccttatgccggaaattgacttcaaaggtcagcgtgccgaattccccatttaaggtctttatcttaccaaactccaggtctaaaatctgataatgggaatcatctgcatacagggataaattctgcatggaaaactcttcgttatactccagatatatttccattgtctttgcgtgggtctttatgtaaaggtcgattttttttaaatacatgagagaaaaaataataaaaacgcttcctaaaatggctcccccgtaaaacccgatccctaccgccagccctaccgctgctgttgcccagatacctgctgcagttgtcaggcccctgatctcgtttttagaagtggtgatgatcgttcctgctcccaaaaatccgatcccgcttaccacctgggctgccattcgtgtaggatccacattggtataaatggttgcaatatactgattggtaatcataataagagctgagccgcaccccaccaggagataggtcataaagcctgccgggcggttccttaagcctcgttccattcctatggccccgcataaaataatggacaaaaacagccggaatgctatagaggcagtgtttacctgtgataacatataaagaatcaatcacctctcccgttttatgtgataagatacataagttcctgaatcaattctctattatctggctggcaattcccttcacaaattacattgtgtctgtaggtcccgcacctggtacaacggtggatgagctgaaatccctttttcgtgtggtatcggatccctgtcggcttcataagtcctttgcagctgttttttctgtcccccgggatttcctcatccacatggagggaaaacaggcaaaaaggacaatggtttctgtaactgccgtttaatatgggcagtacctctcttttgcaattctgacatacaaatgctgcattcagccttcttttttgcatgaaaaattacctccgtttactgaaaaacggaggcattttctcatgatcgtaacacaatgagccgcatattaaatcctatgcagcctccgtttttttatattctcatttctgctgttcctctcatattccatacgcatcactccttttccttctccatatctctattgaatctcaggctttaatttgttcatcaggcagaaatactgataaaattcctcagcttccttccggcgctcctcatcaaggatcgaccgctgcatatcaaaaaggatcttctgcatggttatattggaaaaatacttcagttctacatttccccattttgaaatctccgctccgtcagaaaaataatcccagtacaacagcatttccttatcctccaggcggattctatatttttcatgactttggatcatgccatccctgcaggccgaactttcaaaattatcctgcagcataaaggcccctatgatgcgccgcctcttttctgcgatgcctttgggacattccgtaaggagacaggcggaattcagtttaattctgaccggaatcttgggtttacccttggaaccgccgctctgataagagcctgcatagactgaccatgaagaaaaaacgctttccctgtcattctctacaaacccaaaggcagcctgggaatcaggacggatcttcatattttgtatttcctccaggcgttcctgctcgctgatctcctcagcccgcctgctttcttcctcctgcatgatatgcttcagcatgttatccatttctgtctgcacagttttatccttgagggtcagaaacttcttaaaagaattaggatacaaaaatttcttctctccctgggggaacaatacggtgatatatctttccctcagctccatgaccttgccctcaccgaacttcatgtgactgacttccattccttccaaatgcatgcttattctcctttcaaaaaaaagaaaggcttttcatatctatgccaccggcacaatactaaaagcccttcttacaaaagacggttctttactggtcattggttttccacggaacgccaaatccaatgcctgaatctaacgttcacctctattataacacacaaaacaggaataagcaatacccatcccccatcttcaggcagagatctggggaacacctgaataaataccggctttttatcaccggtctgatctgtatttgattgccagtccctttaggaaatttctggcataccggtcctggcattccttatagttgcgctgcccttcccttcgcaaaaccgcacttaattcaccgttggataaattgattccaacagacttaaaaatatcaagcatatcatcgccggtaagggacagggcgattttaatctttttaagcaggacattattgactgatctgtgattctttatcataaacagcggtttctcctgctctcctggctttggctcctgcctgcctctcttgaaaacaatataaccattcaaaaaggattccagcataaaatcatcgcatatatccctgtcctgatcctcaacggccttttgttctccggaaacgcttaaaccggcctgcggcttaaccagaagtcttcggatcttttcctttgtaattgtgattccgcccaatctgaatatttcgatcatatcagaatccttgatatccatggcataccgcaatcttattaatatatcgttgttatccacacagttcctccttaaggaataaatttttacatgaaaactgcaataaagagattatactcattcgtgaagaaaatagcaatctttctcataggatgttctaaaaaatatggtatactgtaaacacaaactgctttttaagaggggacatttatggataaggaaaaagtgattaaaagcattaaaattgccgctgcagcagtgctggccattgccattgccgctgagcttggcttaaaatattccgctactgcaggcatcatcacagtactcagcatacaaaataccaagagggaaaccattaaaagcgccagaaaccggactttggcttttttgtgcgccttaatgctggccgcagtctccttccggcttctgggctttaccctgattgcatttgcagcatatcttctcttattcgccctgctttgcctgtatgcggactggggagaagcaattgccatggactcggtattgatcacccatttcctggctgagcagtccatgtccgcgcctctcataggaaatgagatcgctttgttcctgattggaacaaccgtaggggtacttgtgaatatgcatcttcgaagaagggaaaaagtatttcagaaactggctgatgatgtggatatgcagattaagggaatcttaaaccgcatgtccctttggctgatggaggaagataaaagcggatatggcccggattgcctcatccagcttaaggaaagcctggatcaggccagaagatgtgcccttaataattacaacaacgcactttggaaaaaggattcctatgaagtggattatgttcagatgcgtcagcagcaaagcatggtgcttcaggaaatttacgaaaacatcaaaagcatcacctgcctgcccagacaggcacagcaggtggcacagctgttaaaaggaattgaacagggatatcacagagaaaatacggcagaagggcttttaaaggacttggaccttttgtttcaggagctgaaaagccatgagcttccctctgaccgggaggaatttgaagccagggccattctgttttatatcttaaagcagataaaagagctgttgatgataaagagggaatttgttctggctcatcgaaggtaatcttaagacaaaggcagagactaagccacaaaaaaatgccctccttgcagcaaatagttacaattctcttcctattcaccacaaagggagcatatcattttatccagtttaaagattatcatgcaaaaccaaaatatctcatgatacctaaaaaaataccatacgcaaatccatactggtcatcacgcagtttttctgaatccaacggactgcttaagtagcccaattccacaaggttggccggcatatttgcatttcttaaaacatacagggatgggttttccctgatcccgttgtttgctgttccagtcacctggtttacgccttccatgatctgctctgccagccactgtgcctgggtataatattggtaaatatatacctccgttccattaatggcagggtttggattcacattgcaatgtatgctgataaaatagtcggccggccatgaattggccatggcaactctctgggcaagactggtggtattattagttcctaatacggtggtgggctccggcctggacacccgtgcttcaaatcttggatcactgtttaataaattcagcagataaatccccacctgatagttgatttccgactcacgcaaaccattagcttccgcaccactgttaaaatatccgctgggattatgaccttgatcaataaatattttaatagccatattagcatttcctttcatacttagctataataaatatatgacctaatcccgcaaatgccacatgttatcaggctttttgtctattttcacatacaaaaacagaagatttcctaacagatcctgggcagactttcgccgtataaaacatcaatggtcctgcttccctgcagcctggttttcattgtcacgcccctgccctccagaactgttccgatgatcctggcattttttccgtatttgcttttctgaattgcctgcaaagccttttgagcctggttttcaggaacaacggctatcatttttccttcgtttgccatataaagaggatccagacccaggatgtcacaaaagcctttgacctggaaactgaccggaatggtttcctcccatatttccaccttacagaaggactggtccgccgcctcattaagaaccgtggcaagccctcctctggtaacatccctcatgcaatgaacctggattttttcgtccagaagatgttttaccatggagtgaagaggtgcgcagtcacttgcgatctggttttcgatccccatccggctggaaagaatggctgcatggtgttctccaagatttccggaaagaataatggaatcccttggcctgcactttgaaatgctgatccctcctttccggatctcacctattccggaagtattgatatagattccgccgtttccctccactacctttgtatcaccggctacgatctttacgcccgcctctctggctgccagtgccatggaagcggctatctgctccatcgtctcaagctctgccccctcttctataatgaagccggcagttaaatatcttgggacagctcccatcatggaaaggtcgttcaccgtcccgcatacggccagcttcccgatatctcctcctttgaaaaacaaaggagtgaccacaaaggaatccgttgtataggcaattttccctttgatatttattacagcggaatcttccagcctgtttaaggttttattattaaaatgctttagaaacacctcactgatgagattgcctgtctgttttcctccgctgccgtaggacatattaattttcatggcctgacctctcctttcattctctttctctaatcccttcaggatcatgaattctgataccagatgccgcatgccccttcctgggataccatacagggaccaatggcatgaagcggggagcaggcagttttaaacaggggacattccggcggattgatccgcccaaggatgactgacttacacttacagccaaccggcatgtgctcttttgccgcctctccatgacttcctgcatcataagttctgtatttctccttaagccttaaagcggatttttctatggtcccaatccccctccaaaacccatcgaaagcttcaaagtatcgttcaatcagtgcagcagctttccggtttccttcctctgtcacagcgctggcatacatatttttcacttcaaagcgctgcttcctgatctgggtcatgatctcatatacggcggccaggatatgctctccttcaaagcctgctatgacaaagggcttttggtatcttgccgccagctcccggtacacttcgcttcctgtgatcacgctgacatgtccgggacttagaaacccgtcaatgtttttttccgtttcacagagaaaggaaagggccggcacaatggtttttaaagaggtcaaaagctttagattctcaattttcttctcacggatctcctcaaggagcagagcatatatgggggccgtggtttcaaatccaactgccgcaaaaacatattgggtctccctgtttttctccgcttctcctactgccaaaaggggagaatacaggattttcacccgtcctccggctgcccttgcctctgtcaggctcatcctgcttcctttgactttcatcatatctccaaaggtgagtacgcaatggttcgcctttagggaatattccgtcagctcatcaatataggcggaagaagtgacgcagaccggacagcctggcccggaaatcaactggatcttaggtgaaatcatggtccggatgccatttttaaagatgctggccgtatgggtcccgcatacctccatgatctttaccggccttccgtcataatttttcagttcatggatcacctgctcaatcatattttatatctcctccataagctgggaaaatatggagagaatttcctgggctgcatcttcccttaaaacctcaatgacacagccggcatgtatgagaacataatctccgacctttgtatccaccagccttatatttgcatcggtaatattgtccataatgttgacctttgcataatcacccttaatttgaatcacttttcccggcactgcaacacacatggcattctgtcctttccaaatccataatcccggattttaagtattcgtttcccagataagcctggccaaggctcactcccccgtcgtttggaggaaccgcctcattccaatagacttgaaatcctttttcccttaaaagcctgatggtatgcccggtgagaagggaattttgaaaaacacctccgcttaaggctaccgcattgcttaagtatctgccccgcagcttcccgcatacagatgcgattccctgcgccagtgcaagatgaaagccaagagcaagggaacctgtctctgacctgcttctcctgctgcagagggcttcaaaaaccggccggggatccaattccaggaaagcctcgtgttccttgatcccaaaagaaagctctgccggctttacccggtttctctctgcaagcaccgcctctttttccagcaatatggcacattctccctcataccggttctcatgcccgatatttaaaacagatgccgccccatcaaacagacgtcccacgctggaagtcaaaaccctgttgacatgatgttccagggcggcttttatcacatccagcctctcatcctgaacgtaagcttcaaggcctgcgtgaagcagacagcaggtggccgttttcctggcatcccccatggacctgtctcctcccagaatgggaaacaggctcaaatgggctgcccgtatgaagtcacttccttcacagacaagaaattctccgccccatatattcccgtccgtcccatagccggtcccgtcaaaggcaactccgatcaccggtccctttaaatcatgctcggcgagaaccgatgcaacatgggcatggtgatgctgtactcttaaaacagggatgtccagagcctttgcaaaacgcgcggaatggtagttgggatgaagatcacagaccgccagcccaggctcaactctaaggagcttagtcagatcatgataggcattttgaaattccttcataaccgaatcttcttccaagtctccaaaatactgggataacactgcatttcctttatgacaaaggcagaaggatgcctttaaatctcctccagacgcaaatattccggcctttgtccgcccttctctttcattccccttttcctcttctttaggaagaaaaaccggatatgggacataacctctgcttcttcggatcaactggggcctgccttcaattattttagcaacagaatcatccacggaacggacaatccttcttttattatataatacaccgcttaaataaggagatgagagagccagcatgagttcatcctcacggatgataggctgtccggaaatattggcgcttgtcatgaccagtggcccaagcctttgcatcagcatatgctggagaggtgtatacggaaggaaagctccgcaatcaatacttccatttcctacagagggagccatagaatcctgttttatggtacgccctgggggtatgcctgtacacccggtgacgcgtggttggctctgcccggaaatcgtggaaataatatggaaagcagaacaatgggccttgccttggattccagcagtgttttttctacctcagaaacaagacagtatttgtttatttccggaattccaggaaacatgactgcaaaaggcttttcctcccgcccctttaatttgcggagccgttttaccgtatcttccctaaaaggggaacaagccaggtgatagcctccgattcccttaattgcaacgatccctccccgggccagctcagacagcgctttttcaaacgcttccctttcccgcagttctccggtgtcatgtttcttgtccctatagatcaggtaggggccgcagtcattgcaggaaatagtctgggcatgaaaccgtctgccatcaggcgaggtgtattcttccagacaggtgctgcacagggagaaatccctcattgttgtacgatttctgtcataaggaagctcctcaattatggtatatctggggccgcaggatatgcagctgataaatggattctgatatcttctgtcagccgcatcagaaagctctttcatgcattccgggcagaccggtaaatccggtggaatcactgatatttccccgccggattcgctccctataatgataaaatcatcaaggtccatgaaaggaatctcttctgcttccatctttataatttcctggccgcccttcctgttttcctttaagccgtccagaaaccggccgatcatatccctttctgcctgggccacaatctcaacatagccgcctacattacggacctgtccttttatcctgtattgtttggctgtacggtaaacaagggtcggaatccaaccccctgtacaatgccgtaaactcttattttttctgtgataacctgtttttttccatgatccattctactaccttttcatagccttctgagctttttccggatacctttataaccggagctgtttgattcaaagcccggactcctttcataaaaaagtcctcgtcaaaatcaatatatggtaaaagatcacatttattcaataaaatcagatcagctttctcaaaagccaaaggatatttatacggcttatcgctgccctctgttaccgttgaaaccagcattttggcatgttccccgatcatgaattcagcagggcataccaggtttccgatattttcaataaacagaatcccgtccctgatgttcagctcctccaccgccttaccgatcagggggaatccaaatggcaggcgccgcccgtattgatctgaatggccttcacaccaagggactggagcatttttgtatcaaaatccgcctcaatgtccccttcgatcacgtaagatgatacctctgtaagacgtttgatgatctgtatcagggaagtggtttttcctgctcccggtgctcccattacattgatagcataaatgccgctatctgttaatgattcattgatctgcgccgcgacctggtcatttttgtcgtagacagactgcatgatttctatttcttttttttcgtccatgttttcctccacacctaaatttcaatagatttgacataaaactcctggccaatatctgtggggcgcccctctccattacagtccggacactcaaaggtgaacggctttcggacaaacaaggctccgcaggcactgcacttaagcctgggcaccacccgttcaatatgaagcctggctttttcacaggggttccttccgctatcaaatcaaaataaagttcaatggaactggctacgtaaccgcaggtatcacccaccaccagattgatgatctttacttcctttgcatgatgtttttcagcgtattctccggcaatctctatgattcgccgtgtgattgggtattcatgcatttcacatattcatcccttacattttcatatgatggcgcagtgtaccggctttccatcttcagacatttcttaggacacacttcactgcaataactgcattgtatacatttaagcctgtcaatactccacatggcttttgatttatccgtttgaatggcacctgtgggacatcttctttcacacattccgcagaagatacattcatccacccgtatcccgatcctgcctctggtgtgttcatatgtttccttttgctttaccggataaggaaccgtataagggccatgaatcaggttttttaaaagcgtctttgacatccttaatatagacatactttcctcaattccgctgttttttgcagcaatgacatttctatatattacggcatatcaccgttcggtacagctgatgcatgggtcaatggtaaggatcaggatgggcacatcggcaagagaacagttctttaaggtttccagcaaagcaggaacattggcaaaggtaggggtacggacccttactctgtccagaaactttgtgccgtttgcctttgtataataaaggacctctcctctgggctgctctaagcgggtgaaattctctccctttggatttcccgttaccttcctttttatttctccatcaggtatgatggcaatgcactgcctgatgagatccatggaatggaacatttccctgatcctgacctttgttctggcatagcagtctccgccctggtccgtgaccggcttaaagtccagcttatcataggctgcatatccctgtgaccgtaaatccatttcaatcccgctggcccttgccataggccccactgctcccagctcaaaagccgcctgttttgacagcacgccgactcccttggtgcggagccttaccgtggaatcattgaggaatacagaggcagcttcctttaattccatttccatgcggttcataacctcccgtatcctgcttaaagtctcaggagcgatatcctttttcaccccgccgatatcacaaacagagaatatgactctgcctcctgtggactcctcaaaaatatcaagaacctgttccctcaatttccaggactgcatgaacaggctttcgaagccaaacgcatctgccaaaagccccagccataaaagatggctgtgcaggcgggaaagctctgcccaaatggtccgcagaaattttgccctatccgggatctctgcccccataacgctttctattgacatacaatagcccatgccgtgcataaaggaacaaatgccgcaaatccgctccgcaacatagacatactgctgataatcctttttttctaccagtttttccaggcctctgtgaacgtatccgatcctggggatggcctcaaccacccgctcatcctctaaaaccagatccagatggatcggctccggaagtaccggatgctgaggtccaaacggaacaatcgtcctgtttcccataagtagcctccattctgatgcaaaaccgcaccatttgcctaatcgttcctctgaaacggtgttttgaccggaatcttatacagggtatcgtgaaagtccggcgcaataccagtgatcttgactccaaatagttccttgatctcattttcataaagaaaggaataagggtaaataatactgatgcttggcagttctgtttccgtatcggtcatgatccgtaagtttaaaagctcataatccttgtcaaaggagtaggtcagttccataccatcccggtttgtacaggtaacagcaacaagccggtaaccatcattttttattttcaatgcctccgccagcagatcatttgcggagatctcttttaatatctgttcagccatgattttctccattgccgcccagcagccggtgtgatttctttttgacggagtcctttctcttttcttccaaaacatcaagtgctttcaccactccgtctatgatggactccggacgggctgcacagccgggcacatagacatccaccggaatcaccttccccactcctccggccacgttatagcactccgcaaaaattcctcctgaggtggcgcagattcccactgccacaactgcctttggatcaggcatctgctcataaagctgctttaccaccggtatgttctgctcattaacgcttccggtaatgagcagaatatccgcatgttttgggttgccggtattgattattccaaaacgctccacatcgtaaagggggtaagacatgccagcacttcgatatcacagccgttgcagcttgtgccgtcataatgcagaatccatggcgatttttttacaacattcataatatcctccattccgcctttgggcggcttttatgaccttccaggaattcatctgaaaaatgacaggatgatcaagttcaccgtacccataataccggtcacgatccatgctgaccgaagcgcctgctgccacttcagccttgcggttgcattatctatgataatttcaaggaaatacacaaacaggcatacaatgaccgcaaaaatacggctcaccggcgcagctgttgcaaaaaatacataaaccagagcaagagatatgatcacctcataccagtgggtcacttcgattactgccaagtccttaccggaatattccgttgtaatgccttttacgatttcctgatgcccgtgatgggacatgcttaaatcaaagggggatttcctcagcttaaaggtcaggataaataaaagtcccacaaacactccgggaagataaaggatggatggttcttgcgccattacaatatcctttacaaaaaaactgtgctccgcataatataagccaatgcaggtcagcagcaccattggctcataagccatgatctgcagcaattccctttctgaaccaatggtattataaggagaattggaggcatagcctcctaaaacgaaaaatactgaaccaagagtcagtgcaaatatggctaacaggatatctcccctgaaaggaggatcacagtagtaaataccacaaacacaagggagatatacacgaagaagcggtgcatggaattgacctcaatggattccttctgaaccagcttcagtacatcgtaaaacggctgaaataaaggcggtccctgtcttccctgcagtctggctgataaaatgcggtcaaatcctgtcagcaagcctcctgcagcaggagcgaacagcacgatccctattatgatcaaaatattcatattacgccattcctccaatcatcagcaccactcctgcaactaaggttgcaattgctatgacatcactccagagagataatttcctgaccccgaagtattcatccatgtaccagttgcgcagttccatcttccgcttctctcccatggctccgtagaaggtttcgttgtctcccgtgttttcacctgccatataaaccggcactcttcttcttttatcatttttatagatggggataaagctgattggcagtatgatgagcatactgagcatgcacagcatcagcttgatatcatttgttccaatggggattgaagccggttttccaaaagcctctgtcaggtaaggaatcagggcatattttgataccagcggaaaggtaaagcaggatactaccaccatggccgcaagtattgtaataggaatttcttcatccaggtggaatttgtctcccccctgctgcctcatattagcccttgaaaccagcttccccatccactttgtccaataaaacaatgtggcagcgctgccataagccagcacaataacgatcacaacgttgttggagtcaatgaaggccttcattgcaacccattttgatatgagcattccaaagggagccaggaacattcccgcaatgccgatcatcatataaagggccagttttttcgatattccaagaagaacatccatattttccacatccctgtttccaatctggtgctctgcagaaccaacggatataaagagcagggatttggatactgcatggaatataatcaaaagaatggctgcccataaagactcctgggtccccacgctggcgcatatgacgataagtccaagattagccagggtggaataggccaggatcttcttggcatcactttgggaaatcgccataagggaacaggccaggaaggtaattccccccacaaaggtcacggttcttcccacaggagttgcgcccaaaagcggcgcaagccggagaagaagatatactcctgcctttaccatggtagcagaatggagaagggcagaactgggagtgggtgccaccatggcaccaagaagccaggaagaaaagggcagctgagctgatttggtcagtgctgccatggataagaaaaatacaggtatcatcatttctgcttccggttttaaggaagtgaccactgataattccagagtattataacaggtgccgatgaaaatgattcctgccgcaaaagcaactccgccccccagattgatcaccagggcgcggaaggaattgtttctggcttccttagtccgggtatagccgatcagcaggaaggaacaaagagtggtaagctcccagcaaaaatacatccaggtcagatcattgcttaatacaatgccaaacatggcggagagaaataaaaatagaactgcgaaaaagaaacccttcctctcttgatattccttgtgatggatatgatatgttttcatatatcccaccgcataaatacaaatcaggctccccaccagtccgacaaccaataccataattgccgtcagcttatcaaaaaccatggcatggtttacttcaatcttgttttttaccgtgaattcaaaacatagcattgctgctgcctgtacaaaggataaaacagaaataacatattttttataccggataccaatggatatcacatagaccgccaccgctgcctctgcaactgccatgataaaatcaatcgccttttcccaatggaaggagaaaacaatcccgtttttaaaatacaatcctgcggctgccaaagtcaaaacagccgtgcctgcggctcctgccctgaccatcatatttcttgtctcatcatttttgacaaaaaggattcctaacgctgcagccaatggaaataaaatcaataccgttatcgcacccatacacttatcaccctgtttttgttttatagtatctgtcacaatggaaaataaaaaaatcaacaacaccgtcaaaattctctaattccatgaacttttccgtaccattgatgaattcgtgctcattataacacactaaaagtggttgtcaatgttttgttttatgtacaatttacacaatttttacactcaaaagtaaaatatagaaaatcaaagcaaaggaaagagagaacttctcaataagcaggataaaactgaaaaatgcgggggcagaccatgcttttatgcaaaaatatatacgacttcttaacaagatttacacaaaaataaacagcatcttaacacaatgacgatttctcaacaaaaaatccaggtgtaaagaaattgttaaattaataaaaaagcatccggatgtccgtccgaatgcctcttttctgcctcttattccttaatgcctgatcataatcctttccccatgcccgccgatccagtagttgacaccgggatatttggctgtaagataatccgcaaacagccatggatcctcactgtttttttcaaacatctcgtaatgggccgggatcaccagaccgggcctgaaagtccccgccatatccgctgcttcctggtatgtcatgttgccgatgacgttttccttatatctcctgccatcccgtccattgatgggaaggaacatcacatcaagcttttcaaatttcctgagcctgccatacatcccttcgtaaatacaggtgtctccggaatggtacagggtgcagcctcctccttccacaacacagccctgataggggaaagaacctgtatccggatcctggtcaagaaattcatgggcagcggctatccctgttatgctcatatcatccaacagctttaaagtaaccccatcatcaagccccagaaaccggtcttcttttatattaagatcgttggaaagggaagagatgagcagttttggcacgataaatttggcatttggagagctgactgacagctgatgccagaccttcctgtcaatatggtccgcatggtcatggcttccaaagatgtaatctgcatttgtcacctcctcaggctctaacagggaagggacccttctgtttggatgcggggataaaaaggcatccatgtaaaaggtcctgcctccaagctttacggcaaagcctaactggccaagccaccaaatcgccgcctctccagcagccggcatggtttcataaatctcattgatcaattccttacctgttttcatatatgtattccacctttcctacgggcttcttttctgatgcattcatcatatcacaatttatttcccatatgtaaatattttatgaaaaacggcagacaaacaagcatcctgtcttttgatcctgagcaatgtataaaactaaaaatttttccggttcaccgctttatttttattttaaaacaggtttttgtggtaaaataaacagagcaaacaaaatacaaaaacagaaagaagaggtaccacatggaacaggaactcccaaccaccattgatgaatacatcacaggccgcgccccggaaatacagcccctgctgcgaacgctgtaccagaccattaaggaagccgcaccaaaagcagaggaaaaaatcagctggggaatggccacatttgtctattacggcaatctggtgcatttttcagcagagaaaaaacatatcggatttcacccggcccccaccgcaattgaagcctttgaagaagagctgaaggaataccgcttctctaagggcacggtccagtttccctatgacaagccccttcccttggaactcattggcagaatggtccgcttccgggtcaccgagcaggaagcgctggcagaggagaaaagggcaggaaaagcaaaggaaaaaacattgcgtccccgctatcccatgcctgatgatgtgatgacagaacttcaaacggaaggtctcacccaagcctatgatgcccgtcccccctatcagagaaacgattatatcggatggatcacaagagccaggcgaccggaaacgcgcagaaagcggatcaatcagatgcttgatgaactgcgctcaggggatgcctacatgggcatggcttattcctccaaaaaaaccactcaggccggtcctttttaaccggccttttttcttccataccatttcttaataattcttaattcccctgattttcattgtcattctatccacaaatgatataatttttcatagccaaagggatattcgcaatgaccaagtgtcacagagctccccgcaccatcgggcggactctccgcttcgctaattgattcggtcaaaataatagaaaaggaggacgccggtccatgaacacagcgcagcagatcctggtagtggatgacgatgcggacatccgggaagttctccgcattcagttggaaaacaacggctattccgtatccgaagcaatgaatggaaaggacgcggtggcagccgttactggaaatcctgatattgaccttattattctggacattatgatgcccggcttatcggggatcgatgcctgtacccggatccggaaaatatcttctgcaccggtattgtttttaacagcaaaatcaaaagaaagcgacaaaacagctgcctatgaaaacggcggtgatgattatcttgtaaagccattttcacaggccgagcttctcatgaaagtccgctcccttttaagaagatatgtcgtttacaaagggaaggcagaacctgcttcagatctttcagaaatccgtcttcaggatatccggatcgacaccgcaggccgttttgttttccgggaaaatcaaaaaatcgagcttacggatacggagttccaggttctaatgtatctggtgaagaacaggggcaaagtaaaagatgcccaggcaatctatgagggcgtatggaatgataaattcctgccttcttccaccaatacggtcatggtccatattttaaaactcaggaaaaaactggagctggatttcaacaatcctgccatcatacgaaccatctggggaaagggctatcagatcgatgaagcataaatggatctcatctttacggtataaacagatatttgtcttgatctttggggcagtcatcagctttggaatgtactttgccgcccaggctttcggagattatctggtatccagaaaccacatgaatgaagatgccgcatggaaacggctgaccaactatcaaaactcttttgaaaattacatcaataaataccagatatccgtaaaaaacgtaagatccatttccaaatgggtgaaaaaccataaatacgtttacgtgaccatatttaacggcaatgagatcatttacgaatccggcttctggaacgatgcctacgcctcctatgaaaccgccgcctctattggggaaaccggcaagcaggccatacgggatattacattcagcgacggcacctattccgtgtccatcatcgattcatcggaaataaaatggtataacctggtgtcctatgtttcatggggagtttttttcctgtttctgtttgtgatcctgatcgcctataaccaccggatcattgccaggatcatgcttctttcaaaagaggtgtccctcattgaaaaaggggatttggaacagccgatttattataaaggaaatgatgaaattgccctgctggcaaaaaatgcggataacatgagaaattccatcattaccagatataaaagcgaaaaggaagcctgggaagctaacagtgaactgatcacttccatgtcccatgacatacggacgccccttacttcccttatcggctacctggaaatactggactcaaaaagctgccattcagaggaacagcttgataagtacatcaaaagctgcaaggaaaagtcccttcagctaaaagatttatctgaccggctgttccaatattttcttgtattcggcaaggagcagattttgatgcagatggagaccttcgatgcaaagatcctgctccagcagctttttatggaacacgtatttgaccttggcaacctggggtttgacgtaaagacagaatttgtggagcagtcatgcagcataactgctgacctccaatatttaaggagactgtttgataatctgttttccaatgtaaaaaaatacgccggcaaggatgagccggtcattgtcaaaagccaggcagacagcagcaacctggtaatcatcatttccaatgagatccgcaaggacagcgagtttttggaaagcaccaacattggactcaaaacctgtcagaaaatcgtagaacaaatgagcggtacctttgaaatgcgaaaaacccggacaaatttcaacgtccgtgtaacgtttccaatggaatctgccagagaggaataagaacctatgagaaacgtattagagtatctggaacattccgcaagcctgtaccctgagaaaattgctgcggaagatcagataacatgctgctcttaccaggaactgttgtcaaatgccaaacggatcggcagctttcttgccgattttgaattaccgggaagccctgtcgccgtcttcatggataagagcgtggaggccttaacagcattcatgggaatcgtatatgccggctgcttttatgtcctcatcaacccggaacagccggccgcacgcatacggcagattctaaaagtccttaaggcaggctccgtcatcaccctgggtgattccagtgcgctgccggaagacgttggatttaacgggaatctgtttgattaccagacagctgtaaaaagcggaataaaggaagaaaccttgcagctcatccgtcagcggtccttagatatcgaccctttgtactgcaactttacttccggttcaacgggagctccaaaaggagtattggtcagccaccggtcggtcattgactttatggaatattttccttccatgttcggcatcgtggcggaagacatgataggaaaccaggcgccctttgactttgatgtgtctgtaaaggatatttactccgcccttaaggtgggggcaactatggtcatcatcccaaagaggctgttctccattcccgcagagctgctggattttctgtgtgaacgcagggtaaccaccttaatctgggctgtttctgccctgtgcctgatcacccagttaaagggatttacctataaagttccttccagggtcaataaggttttattcagcggcgaggcaatgcctgtgaagtttttaacgatctggcagaaataccttccaaacgcaagctatgtaaacctgtacggcccaacggaaatcacatgcaactgcacctactaccctgtaaaccgggaatttaaagctcatgagacgctgcccattggaaaaccgtttcccaatgaaaaggtctttctgctggatccggatgataagccggtcacggaaaaatgccggagcggggaactttgcgtatcaggaacggctttggcccttgggtattataacaatccggaacagacaaaacgggcctttgtgcaaaatccccttaacacccgttacttagagaccatttaccggaccggtgatctggctttctatgatgagaacggggagctttgctttgccgggcgtaaggattttcagatcaaacacatgggccaccgaatagagctggaagagatcgaagccgccttaaacagctgccccctcattgaacgggcatgctgcgtctttgatgaggaaaaaaaccggatccttgctttttacgtaggtgatatgaaagaaaaggaaatttcagttgaaatgaggaaatcccttccggtttacatgattccctccgttttctgccctctccgttcattgccggtcactgcaaacggaaaaatggacagaaaaaaattattggagatggagaaaggaaaacagccatgaatgagacgaaatttgaatatgcccttcatgagtacactactcccttctacatttttgatacggatatcctggcaatgcaggtcaggaaaatccgggatgtcctgggacctgaaactgaattatgctatgccatgaaagccaatccatttgtcattaaggagctggaagagctggtggattcctttgaggtctgctctcccggggaattatccatctgtgaaagagccggtattaacatggggaaggccgtcatgtccggcgtacataaaaagcctgatgatttgaaatatgccctggaacggtatggagataagatcatttatacagcggaatccctctcccactggcagatgcttgccgccttaacagagcgccttcatataccggcccgggttcttctccgcctgacttccggcaaccagttcggcatggatggaagcctgatccggcagatcatcgcagggggcccccatcaattcatgaccattgaaggaattcagtacttttccggcacccaaaaaaaatccttaacaaagctggaaaatgagctgaagatgctggatcagttttgcagggaattaagccagcagtatggctttgcagtaaaaaagctggaatatggtccaggacttcccatctgctatttcgaagaagagaaaaatatggaggctgaaatgttaaacggccttgcagaatttctcaaaaaccttacctttgggggaagggtcgcattggagatgggaagatttattgccgcccactgcggttcttatgtgaccagggtggcggatataaaaacaaacaagggcgagccttactgcattgttgacggcggaatccaccagcttaattattacgggcagatgctggccatgaaaaagccgcccatccttccttttcatcaacggaatggggagaaaaagaaatggacggtctgcggctccctttgtacggccggtgatgtgctggttaagcagcacccctttcaagacctttcagttggtgatccgcttattttccaaaagaccggtgcttattcagtaacagagggaatgtccttatttttaagcagagatttacccctggtccttctctattctgaaaaagagcggttccgcattgcaagaccccgttttcaaacggatgctttcaattatttccaatcataaaggagactaaaatcatggaacaattattagaaattttaaatggaatcaatccgggcattgactatgaaacagagacaggacttattgacggcgccctttttgattccttctccattctctctctcattcctgaattagaggatgcctttggcatcaatatcactcccatggatatggtacccgctaattttaattctgccaaagcactatggaggatgatcaaccggttaaaagaggaataggccatggcttataactcactcctgtacctttttatctttttgcccgttgtattgctggcttatcaccttacgccccggcactgccgctatagaatcctgctgtgtgccagttatgttttcttcctctccttcagcggaagacttctggcgtacctgattttttccactctttccattcatcacatgggcttatggcttgcttcctgtaaaagaggctatttatctgtggagtatgcccctgaggataaaaaggcccgaaagactgcttatgaaggcaagcgccgcagaatcttgtggtttgggattggattgcagcttagcattttactggttttaaaatactccggcttcttttttgaaaactttaatgttttactaaaggcaatttcatttccaaggcttctgccttccatgaaattcgccctgcccattggtatttccttttataccctgcaggcgatttcgtatctgatcgatgtttattatgaaaaaatagaggctgatgacaatctaagcagactggctctgtacctttctttttttccttccctcctggaaggccctgtctgccgctactctcagactgcccaggctctgtatcaggggaggcccctggaatataagaacgtcacttacggccttcagcggatgatgtggggattatttaaaaagcttgttattgccgaccgcctgaacctgcttgtggaaaccatctttgacactcccaaccattacggcggaatcatcgttatcgcaggagccgtattatatacctttcagctgtatgcggatttttcaggttgtattgatatgaccatcggaaccggagaaatgtttggaataaccattcccgagaacttttgccagccctttttctccaaaactgcgtcggaattctggagacggtggcatatcactcttggtgcctggttaaaggattatatcttttatcccatatccttaaccagattcgttaagaatctgggaaagagctcccgggctaaattgggaaagcatatggggcaggtcatttcctcttctgccgcactgtttggcgtttggatcttaaacggactatggcacggaacaggctggaactatattttctttggaatgtattattttgttctcattctattggggaatctgatggaaccggagatacaaaggatcaccggggctttaagggtccaccggtccggcactttgtaccggggctttcagacaataaagctgcttttgatcgtgtttactggagagcttttcttccgggcaaacagcctgacttcaggcatggatatgttccggtccatttttaccggctttcactggtccgcggtaacagacggttccctgcttaagcttgggctgaccctgccggattttcttgccgtattctttggctttattgcggtatatgcggtgggcgtgatccatgaaaagggaatctccatccgtgacaggatttccggctggaacagggctgcccgctggagctttctttacgccgccatcctccttatcatcgtgctgggagcatacggcgacggatatgtacctgcaaagcttatttatgccggattttaagaggtgatgtgatgaaaagcaaaaacaggataaaatcaatttcatttttaaccggacttcttattttactgtacattgcctcctacttgcttattccctataataacatgggagacagtttatataaaaaagcaaacggcattctaaaggagccaaaagataccatagactatgtgtccataggggacagcgaatgcagtgccagcatttcacccatggagatctggaatgcttacggctactccggatataactgcggcgtcccaagccagcagctgcaggatacatactatttactggaacaccttcttaaaaaccagcacccaaaagttgttttcctggaaaccaatgcattttaccgggatttcaaatacatcaacacccttgaaacctccattgaggaagcggttaaaaaaatatttcccatttacaaatatcacgacaactggaaatattttcatttttacatgctgaaggccataggacataaggcaaaacaggcgccggctacggtttataagggatatcaatacagcgcaatcgtaaagccttacaaaagcgggccttatgtcacggaaacagacgatgtttatgtgatcgatgaccagcccttattgtacttaaataaaatcgcaggcttgtgtagggataaagatatcctgctgatcctgtacagcgctccatcgccaaagtgctggtcctactccaagcacaatgcggcagcggcctttgccaatgaaaaccatttaacttatattgacctgaatttagatattgataccctgggcattgactgggcaaatgactcccgggatgacggggatcacttaaattactttggagccaaaaaggtgtcagactatatgggaaaatatttgctggaacacatgagcctgaccgaccaccggaaggatgagaggtttgatggctggaacagggaactgaaaaattatcttaagctcacggaacaaaattaacactcagagcattggccggccgggtaatatgccggcccaatgctcttttgatattctcaggccatcacaactcagccctcctatttttgtatgtaataggacatgaaatccgccagctgatcacatgccatcttaagctggctcagttccggaaggtaaaccacccggaaatgatccggtttttcccagtggaacccgcctccatgggtcaataagatcttcttatcctttaaaaagtcaaggacaaacttttcatcatcataaatgttgaatttaccggtattgattttagggaacatataaaaggctgcttttggctttatcacagaaatccctgggatggcatttaaggcctcataggtgtattctctctgctcgtagattctcccgcctggcaccagcagctcttttgtttcctcttccatttccagggcagcttcgatcacggactgggcaggaacattggagcagagcctcatggaagataataaattaatcccttccacatagccttttgcaaaggacttatccccgcaaaggctcatccagccgcagcggtatcctgcaatcaaatgggatttggatagaccgttaaaggtaatggtcaaaaggtccggggccagggaggcgatggacacatgctccaggccgtctaaaaccagcctgtcataaatttcatctgcaaagatgatcaggccatgcttccggcagacctccacaatttcttcaaggacttccttcggatacaatgtgcccgtaggattgttgggattgatgatgacaagtcccttggttctgcttgtgattttactttttatatcctcaatatccggataccattccgctgcttcatcacaggtgtagtggacagcggttccccctgaaagggtcaccgaagcggtccataaaggataatccggcgaagggaccaggatctcgtccccgcagtttaacagtccctgcatgcataaggtgatcagctcacttacgccgtttccggtgtatacatcatccaatgttacctgttcgatcccttttttcttacagtattttacgatggcccttctggccgaaagcagccctttggaatcagaatagccttccgtatggcacaggttttcattcatctgcttaagcagctcctccggcgcccggaagccaaagggggccgggttcccgatatttaactttaatatatcaattccctgttccatcatccggttggcttcatccatgaccggacctctgatatcatagcacacatgatccagcttactggatttttcaaaactcctcatcaatgctctccttctttctaagtaatttaataggggaaggtaataaaaaaacgccctaaacgtcgaaacgtttagggcgaatgtacaatccgtgttaccacctaaattcagagaaatctctgcactctctacgataccagcatatcgtgtccctgtaacgtgggaatacgttgaagcctactaaaccatcttccctggatcagggaaaaaaatgttattcggttcaaagctccgagactgcttcgatatactaaaataaagattctcaccaaccatcttctctctgaaatttattgtatatgtactacttctcttcattgccttttcactatttccgcaataataacacaggaagggggaattgtcaattgtgaaaaatgctttttatctgtgaatcagtttccctcaaattcccgcatccgccggaaatacaattcctcccttacgccttgcaatcgtctggatctcgcttaccaacagcgtgtggtctaaaagctcatagcatttttctaaatcattgccgcagatcatgtcctgatattccaggaattcattcatcatgcggtgatcgcagttgttctcgtttataaaaaattttgtatcatcgttcataattacttcaaagttatcgcagatgctggcaggtgtatcctgatggataactcctttatctccctggatgttgtttgctatgggagccttgcagtcctttgctccgatacaggtgcatttaaaggttccgtaatccaatatcaatattccggaagtgtcgattcccctttccacatttggaaagtattccacctttaagggcctgccgaacaatcctgcaacgtagtggatgttataaatattaatgtccatgagggcaccgccggaacacttaggatcaaaagcaggcaaaatgcggccttctttaaagctgtcgtatcttctggaatactgggagtaattgcattgtacgatctttatgtttcccagggacggcagcagttcttttatttttttgtaattgggcagatgcagggttgtgaccgcctcaatcaaaaacagcttcctttccctggcgagcccgctcagcaccaaagcctcctcataggttgtggtaaagggcttttcaacgatcacatgcttgcccgcctccaatgcctcttttgcaaactggaaatgcagatgattgggcagggccacataaaccgtgtccaaatctccgtttaaaaattcctggaaatccgtaaaaatatgttttatgtggtacttatctgcaagctccttacccacatcttcacttctttttgtacagcagatggcagttacctctgttttaaccaaatgctgaaccatgggcagaaactcccccacgatcaatcctgatccgacaatacctaatttcatacttatcacctcttgagtacaattcatgttccatttccatagggaatgagcataaaactcctccctttaaacgaccttcctcaattctcctgttacagaatctatcaccaatccgtataccatgatctcctccgggacaaagggatggctgcgtatcagctctacggattttttaatggataaatccagatccataaagcctcccagccatgaatcaaagtcaatgccatagtattttaccaggtcaatgctcttttgatcaattccccgctgtttcatcttttcaatgatcttcttgctgtcagtgtatctggccccgcaatcggtgtgaccgatcacaaagatctccttcacatccagctcgtagatcccgatcaacaggcttctcattgcgcttccaaaaggatgggaaatgattccacctgcgtttttgatgatttttgcatcaccgtttttaagccccagagctgacggcagcagttccgttaatcttgtatccatacaggttacaatggcaacctttttatccggatacttatcggtaatatattttacatacccgtcgttttcaacaaactctttattatacttcagtatttcatcaatcatcctttattcttcttccgttgtttattaaccctgccgtttaaaacagctttaaataattcccatatccttccttctccatctgttcctttggaatgaaccttaaagaagcgctgttgatgcaataacgtagtcctcccctgtctatgggaccatcctcaaacacatggcccaaatgagcgtctcccagcctgcttcttacttccgtacggatccttccaaagctgcggtcttctaaattctcgatagactccaaatcaatgggcttggaaaagcttggccagccgcagccagactcgaatttatcggttgacataaaaagcggttcccctgttgtaatatccacataaataccctcttcaaattgatcaaaatactcattttgaaaaggaggctcggttgcgctgttctgggttacttcaaactggatatcagtcaggtcttctttcaattcacctctagttttttttacaaatttcctgcttttatcctctgccgtcttagccttttcaaatttatcagcaccgatatggcaatagccgcccggatttttgtctaaatatttctgatggtattcttctgctctgtaatagcaggaaagagactttacttcaattgctatcttttcttcatattttttctgaagttcgtttatagaatcccggatcaccggctcatccttgttttcggtgaaatagatcccggtcctgtactgggaaccgatatcgccgccctggcggtttacgcttacaggattgatcacgtcataataaagctgcagaatatacggcagccctatcacggtgtcatcatactccaccttcaccgtttccgcgtgccctgtatcatagctgcacacttccttgtaagtaggattttcggtattgccattggcatatcccacctctgtaaacagaacgcccggaatattttccaagtacttttctgttccccaaaagcagccgcctgccaaataaatttctttcttcataggaatcacctctcttgaaaataaaataaaatcacctgatatcgtattctttcatcagattcaccgctgactttacgatctgtgccgtcatgccccatatgatccagttctcatatttgtaaaacaagacgtcataagttccttttgcccaagggtattttacccctcccggaatccattcatacggaaagtcttccggaggttctgaaatcagcttgctcacaaatctctcaggctcctggctggaaaggaaatccagcggcacctttatgatctcttccacctcatccctgctgaatgtatcctgatagtcatttataacgccgataaaagaatggatcattaagttaaacggcgataagtaaatatcccccggtcccatcacttctatccgctcaggcagtacattcagctcctcagacgtttcacgcaccgcacattcttccagggattccccttcctcaagctttccgccgggaaagcagacttcccccggctggcgtttcagttgattggatcgtttttcaaacagcagatatgtgattcctgaaatgcggatcaggggaatgagcaccgcatattgtctgaatttttcttctccgataattccaggacgccggatcgaaaattgttccatctccagaataatgcctccttccgctttgggatccagccggcatagaccggtccccaaaccatgcaatcaatgctatataaattttacatcaattctcatataataacaatcgttattcctacttatatggtatataatcatcctttactttgtttaagcttaagccataatctcctgtatttacccgatctttaaggatttttactcataattgtgatataatctctttgaagctttgaataaaggaagaaaaccggccacacaaaagcggtataaaataatataaacaggagaattcagccatgaaacaaaatcaatacgataacaaaactttttttgaaaaatacagtaacatggaccgttccacaaaagggcttgccggtgcaggcgaatggaagacccttgaagcaatgctgcctgattttaaagatagaagggtgctggatttaggctgcggatttggctggcactgccaatatgccatagaacatggcgccaagtctgtcacaggcgttgatatttcccaaaatatgctctcagcggccagagaaaagacaagcaataaaatctcctatcaccaaatgcccatagaggatatttctttcggagaaaattcctttgatgccgtcatcagttctcttgcattccattatattgaatcctttgaaggaattgttgagaaagtatcctcctgtcttgtacagggaggagattttattttctctgcagagcatccggtttttacggcttatggaagccaggaatggtattgcgatgaaaccggaaagatccttcacttcccggttgacaattacttttttgagggaccaagacaggccaatttccttggagaaaaggtcaccaaatatcataagacactgacaacctacttaaatggtttgatgcagggaggatttgaattgaccggagttgtggagcctcagccatcaaaacatctgctcgaaaccgtcaaaggcatggaagatgagcttcgcaggcccatgatgctgattatttcagccaggaaaaaataaacggaatgaagaagctgcaaaggcaccgggagaaatcctgatgccttttttccggctgagaacgtctataaggtgccttactgagtcccttctatatagaaccgccaaagatagtccctggcttcttccgcataatcgatccctatccgttttgttgctatgatttgaaagtcctcacctggcccctcctcaatatatacctggtcgccgcataagtctgcgccgttaaagcttctgtccagggataatgccttgcacagctttccaggcccgtttgagatgccctttcgctgactttttgacagttcctcataaggctttccatatcttttttccgccatctcccggattccctccaagggttccacacctcttattaaaaccgcctggggaacgcccttttcccttgtcaccacattaaagcagaagtacatcccatagattggaaatatataggcaaaaccaggatctccatacatgacttccacccttggagtcctcctcccgccgtaggaatgggccgccttatcttcaaggcccatataagcttccgcctccacgatcctggctgagaccctctgcccttcccattggtgaacaagtacttttcctaataactccctggcaaccaggatcgaatccctgttgtaaaactctctgtccagttttttcatcccgtcatcctttctctcgtattttgttaatagtaagtgtttgaaaacagggtttgatccagacaatttggaatatccttgccaaaagcaggatggactgccgtccagagtcactctccttaaataaaaatcgtcccttttgaggacgaatctgatttttgggctgaatcattccgccagatcttttaacaagcttaccggcccacatgacggggtgaaccggtaagtccatttacagcttgtatctattttaatgccgtaaacatccagttgatgccgtatttatcctgtaaggatccatgaagagctgcaaaaaatgacggggccagttccatatatatttctccgtcctgttttaaaataccccatgcttttttcaccagcccagcatccttagttgtgatggatacatacatattatcaccttttatgcttcgttcggagctgtcagcgcacatgatctccataccgtcaagctgcaccttggcatgtaaaaccaggttcttgtcttcatcgggaatagggaaagcaggattaggcggcatgtcgctgtatttttgcatttcaatgattttcccgttaaacgccttttcataaaccttaactgcttcttcacagtttctgttaaacatcaaataatgacctaacatggtaaaacctcctgttcttatctgcacgatgtaatgatcaatgattaccgttatttttagctttctccctctaaatataccatgtaaacagatgatcgcatagcaaagatttctcagcggttttccttccggctcaggagggaatgcatgatgtttaagatattttgcttactcatgggttcggcatgccccatgacgcaaatatcaaaatcaaatccttccactgccgtaatcaatgaacgcagtttgctcttatctaaaaagcagttattataataatccactccaaccccatctccaatgaacaacactctttcctcaggtatgaatacgcagacacagtcttcactgtgaggagatggcacatgatgcaattctgcaaaaacgcctcccagatcaatcttcataacatcattgaaagaaagatcagaagtcaccacccgtatttccgaaagcagcggatattctttacggatacacgtatccgcaaattcgatctcaatcttttcttccagcctctttttcatctcagaatccgtccatttccattccgccatttcttctaatttagcgttggttttttcatgggcaatggtgatccctgctgctgcgtgcaaaccaaaggtgtgattccaatgccaatgggtgaccgcaatcatgtccggcctttttaagccttccttatccagagcttcataaaatgattccacatgacttttggaattgcctgcgtccaccataaaagaatatttctgcccttttacatatccaaggaccggcctgtcggcctctttatcaaacatgctgtaataaataccatctgtcagctgtctaaattccatatattaaatcctcctgttcaatcggatattcccaatgaccaagggtcacagcccacccagcagagcctcacccgcactatcgggtggcccccgcttcaccgggcataacctctgtgctatcctggtttttccgctataaaagccgccactatgtgacggcttaaaagcatatcatttaccagaggcgctgtcaatccttaatcaggaaatcccatttttgaaatctcctgaaaattacaatctcatatccacatactggccctttatctcttcttcagataggtgtatgtacatagaatctcccgctgtatcttccaggcggtctctcgtatctccttcttctgtcctctctttattttctccggatacctccaatgttgtttcagcatcagcagcccgtttcatcatatcagaagaagcatcattgatgcgtccgttgagctttgcaagttcagcctcctttttttctgtggatcctcttcctctgtctgtttttatttccctctccaatacaccggctctgccctccatccctgttttcacggtttggaccgttttcacctgcttcatggaagtatctgcatggatcaaacctttcatggaaacggtttccatcataccggattcctgattctccgcattttgagaaacctcatccatgctatttactttagcagctgccttttcccgtctttcctgctggatttctatttttctctgggccagctgtttgtttaagtcctggagctgctgctgtaaatccctttgcttgctcattttttcttctgcagatatcttttcattaccggaaagaacctgtaactgcttctgcacattttcaatctgatcctgaattgctttcagactggtatcctgatttccgctgttcataatctgcatctgactataattagctgaataacctgacgtacctgtcaccatcataacaaaatcccccctataatcaatttagaaatgctgttcttccatttttacaaatgcctgcctgaaatcagacaaaccattatgataaacctaaatttataagtgctctttacaggatagcttttttacctccagcttaaatacacaaactgcattgatcattgcatcactttgtctctttatccagaaacaccctggaaccggtagcacccttttgtccctgatattttcccttatagggatttaaagcaatatcatccaactgggcgaaaacaagctgtccaactctgcggcctgcctgcaattcgattgcacagcgattggcattaaataattcaagagtgatttctccctcaaacccaggatcaacccagccggcattctggataaataagcccattcttccaagtgagcttctgccctcaacaaatgccgtaagatcattgggcatcacaaaatactccaatgtggtggcaaggacaaactgtcccggaagaagaatgtacttatccgtctggattgttttatagctgatttcattttgcattgtaatgattccattaggtgaatcctcaacaatgctgaatgtatttccaaggcggatatccacgcttgcaggctgtatttgttcctcttcaatcggttcaataaataatgttttttcctttaacattttaaagatcgttttatctgataaaatcatagtaaaatcctttcatcctatcctataataatccacggttaaatctgcagcatagagttctgatcccgcagcattccgcatttatcttccggcaggtattcaaattggtgcctgtgatacagtaagtcagcagggcggttggctatcaggcaaatgtagctgtcttcatgggcgttttcttcaaagtaacggtcaatggccctcataatctgctccgcatagcctctccgctgatactccttatctaccataatatcacttacaatataagtgatccccccatctcccactaccctgccaaacccgaacagtttttcattatcatacagggataccgtgaacagggaattcttcaaggcagtctgactcctgtttaaatctttgcttcccattccggaacgcagccgaaggctgacgtaatcccgggccggcggagcttcataaactatgtgtatatccatatttttcctccgcaaatttcggactttattaaaataatgctcattttctttattataattgtcacgcatatgttggcaatccgattcgctgctcacttgatttcgttaaatttatccttcgcctgattcccggtccatatccagttctgtttcgagttttatttcatttatggtgtttaaccagttatccagaaattccagcgtaatcaattccccgctatgatagatttcgacatcagcacctgaatctataagagaacttattaaattacgaaatataacttttttatcaatactctccaactcttctaacacatcaaaataatgcagatcaaacgatactgcaaaattattatgtatgatattgtgctttattatattgatgggcatcgaagggtcaaattttcttatttgagaaatatattgattgatattcccatgattttttattttaagctgtacgagatccatagaggttatccttccagagaaagcctcgcagccttttcggcgtggatttgtgcggtatcaaaaacaggtaattctgtatccttttgctgtatcagcagaccgatttccgtacagccgagaatcactccctgtgcgccttgttctgcaagaccatgaataatcctgcaatattcttccttagacgtttgggaaataacgcccaaacacaattcatgatagatcacatcgttaacaatttcaatctcctgttcatccggaattaagaccgtaattcctgcatccactaacttttccttataaaaatcctgagtcatggtatattttgttcccagcaatgcgacctttgtaatgttatgacgctttaattcctctgccgttgcctcagcgatatggacaaggggaatgccgatgctcttccggatttgcggaactaccttgtgcatggtatttgtacagatcacaataaagtctgcccccgctttttcgagatttttagctgcccttgataaaatatcagcgcttttatcccagtctccatctgcctggcacttctcgatttcagcaaaatccacgctgtacaacaaaacctttgcagaatgcaagccgcccatttcctttttcactgtttcatttgcgattttataatatgtaactgtactttcccaactcattccgcctatcaatcctatggttttcattttcatttcccctcctgattcttatttgctgatattataacacaattattttccctcgtctttagcggaatccgattgcagacaaaaccaatccatgaatttatttttttaagatactattgactatccccttgggtgttggattataatgttcctaggtgatgaatatgttaatcaatgaaacaagcaaaacaaccaatttgacaaaaaaagcaattgaatactacacagatcagaaattgatcgttccttctgttttagaaaacgggtatcgtgatttcagtgaaagcgatgtggagtgcttaaagaaaatatcagtcctacgcaaacttggaatcagcacggaagaaatcaaagcaatacttgtcgatgaaacaggtgaactgctgcaaaacctttcggttcagaaagaactggcagcccaaaaagagcagaaaaagaaaggaatccttgaccgcctttcccgggataaaagctatactgacgcagccagggaactggaagcccttgaacagactgcaacaatcgcggaacggctgctgaatgcatttcccgggtattacggcaggtttatctgcctgcattttgcccgatttttaaatgaaccggttaaaacaagtgaccagcgcctggcataccggaaaatcatggaattcctggacaatatgccggccctgagtgttacgcaggatctgcaggactatttaacagaatgtacacagcatatcagtactcagaatattgctgaaatgatggaaaacacaaagaagtccattgaaaatccggatcaattcctgtcagagaataaggaatatctggaaagatatctggaatttaaacagtcagaagaatataagaattccccggcatttaaaattcaaaaccaacttaaagaatttaacactacaagcggctactatgatgtttttattccttccatgaaacgtctgagcgcttcatatgaggaatattgccggcaaatggaaaacgccaataaaaaactaattgaacggtatcctgaaattgctggactatatgactgaaccaaggagtccctatccccgttttttatattgtccatggcaaaaggcatacgttgtgggtgaggacttacttgtgtcagaaggggcaagccctttctgacaagctgctccagtcataatccaggcttcttttaagaaaacctattatttctttgaacttctcatcgcttttttatgggcaatgcccgggtcagcctttaacctggaatattcttctgaatccacgccataaatggccattctcgaattttggtcaaaatggattccccagccatatttcttcggcagattggaagaacgcatacatgcctgtcccttggaaaacaatcgctccctttccatctctctttgatcgtcaggaatctcattcctcataacctgcagctctaagatcagttcgtctgaggtgaatctatagggatattcctttaacaattcatattgcattctcggtatggacttcttttcttctttaagaggaggttctatcccactctctgccctggaatcatctgaaacctcaataaatgtgtttgtataatcagtcgtgtgtgccataaattaatctccatatctgcttgagaaacagttttcagcgatttaccacccggttccttgacccttgtccaatttgttaccgcattttcaaatacctgatcaacatccgccctcagcatatcgggggaagataaaagaatcgtgcttggtctggtgtccccggcttgtatcctctgtaattaatttacacaataaatgttaaaattacaaataagaaatcaataattacaatatattcccatatcctccaacatactgtcataccgatttatccccatgcctccccattttgttatattcagagaaaagcttcaatatattactactgtaataaaattacgaggtataatcaatggctgtcccattaaatcaggtaaccaaccccacggatgaacaacggcgagaaatgaccaggaatgcattggaaacagaaggccgtccggaagattacgaatatattgccaacttactgagtcctcccccggatattacaaattacgcagctcccggagaactgaagggaatgaggatcggcgtcatcggcggcggtctggccggtttatccgcagcgtttgagcttcgcaagctgggagccgatattaaaattctggaggccaatgaaaatagaatcggaggaagagtttatacctattactttgatccggaaggtaaatactacaatgaattcggcgctcacagaattccggtgacccatgaaaccacctggcattatatcaatctgtttggccttaacacccgtcctttatcagtcataagacgcaacaactttttatacgtacataatattcgtttgagaacatcagattccattgagaagatcctttatcccttctacgatctgacgccccaggaacaaagtactccttgggcggaacttgatgattatgcctttctctatctcatgaaccagcttccccctgatgtccggtcagagctgatacaaattttaccggagtactccccggaatacattcctcttatgacccattctgtccgtcagactctggaaaacctgggattaagccagggggccatcagcctgatctcaggagtggatcctggaaccggttctttgctcaatgccagttatgacgagatcacccatgaggaatatactctcgattaccgaaatacctataccatccagggcgggatcgtaaatctgccatacgcctttatccaatccttctcgcagacgatccgccccagtaccagaacatcctgtcttcccagcttggcacggtcacttatgagcccggtcagacggttaccggcatttaccagtcgccaaaccccgatcaaataatcctgacctaccgcaatgtgagtgatttcaaaagagctgccgaagttttcgactacgttgtatgtgccatcccttactccactctgagggaggttgaaatcaagccatatttcagcaatccaaagatgcaggcaatcctggagtttaactatgtcaattcccagaaaacacttttcatgtgcaaccagcgtttttgggagcaagatgccgattatgggcggatggtgggaggattttcccagacagacttaccgatccagtccatcttctatccgggagatcataatctttgccccaatgcttccgactgctcccctatgaacccggagttctggtagcttcctataattatcatttgaattcaacgagagtggggaatatggaggaaacgctccggtatgatctggtaaaggagagtgtggaagatgtccacggattgccaagaggatttttagataccattgtggaagaccataagaccgtggtatgggataaccagcccaataaccggggcgcttttgctatggctctgccaggtcagaaaaagttatttgcctatgaaatgctgcagccggaatttaatcagcggatctactttgccggtgaacacgtatccacaaaacatggctggatgcagggggcattgtatacgggaatggctgctgccaaccagctggcccttcattttcataatcgtttttattaaaccatgacatgattgaatctgcaaattcttttataacaaagccgctgcgcttaaacctgaaagcgcagcggctcttactctgtcataagcccatattatccggtccaaatcccattggcagcagttccttcaaagaaaagatctgatactcttctcttcctgccgccaatatgatccggaacgtgtccgggtcgcagaattccatcatcacctggcggcagactccgcagggagccgtgatccctgtgggaactcccccttttcctccaacaatgcaaatggctttaaattctctcacaccctggctgaccgccttaaaaaatgccgtgcgctccgcacagttgctgggagtgtaagcagcattttcaatattgcatccctgatacaatgtaccgtcggcagacaacagcgctgctcccactttaaatcctgaatatggagtataggcttttgccatagcctcaaatgcctgatcaatcatttcctttacaggaagctcttctaccaacgcttccccgtaagttccggcattttcctctgttttttctttcatctccagcttcctttccgtgcccgctcccgtaagtcaaaatccaaggtttccgggatctacagttccagggcaatttccatcatttttccaaatcccagctgccgctcctctgcgctgagtttttcttcaccataaatcaaatcagaaattgtcagcaaacaaagggctttctttccggccgcagctgcattcatgtataaagctgctgtttccatttccacggctaaaacccccatgccgcgccacttgtcattgacattggtatcgtgattatagaaaacatcagaagaaaggacattgcccacgaccacttttgttcccagttttccggctgcttccgccgcttttaccaaaagtccgtaatcggcaacaggagcaaatgtgcccggaaggccaaactgataagcgtaattggaatccgtgcatgcacccattgcaatcaccacatccataagcttcacctggtcctgtaaagcaccggctgaaccgatgcggataatctggtccacatcataaaaatggtacagctcataggaataaatgcccatggacggcattcccatcccgcctcccataacggaaatttcctttcccttataggtccctgtaaatccgagcatgttcctgaccgacgtcacctgaaccggattttccagatacgtttccgcaatgtactttgcccgcagaggatctccaggcattaaaactgtttttgctatttctcctttttttgccccattatgggcggttggtgtcatctccattagatcgcctcctcttttataattcatcctgacggatcatgaaacgtatggcctctaccgccgtccggatggccccatccgtatcatggacgatgggattttccaggccgtgtctggcccgttcctgattagctatcaccaggaatacggaaccggccctcaccttaagggagctggcaacgataaagagtgccgccgactccatctccgaagccttacagcctaagtccacccatgccttccatttgtccaggagttcatgggatacaggctttgtctccggagaatgctgcccataaaaagaatccttacactggacaactcctacatgatacggtttctccagcgcttttgccgcctctgccagggcgtttgtcacttgaaaatccggaactgccggaaactcgatgggagcgtattccctgctggttccctccgcgcggatggctccgttagctatgaccaagtccccgctttttacctccatatccattcccccgcaggtgcccacgcggataaaagtatcggcaccggacatcaccagttcttccatggcaattgcagccgacggtcctccgattcccgtggaggtcacactgaccgcctggccgtctaaggtaccggtataagtcacatactccctgttgtccgcaatcagcctgggattgtcaaaatattttgcaatcagggcacagcgcttgggatctccgggcaggatgacatacctgcccacatctcctttccccacctggaggtgatactgttttccttctgtttcagaataattagtcatatcaaatccgcccttcgctaaatctcattctcatcaattttttctgctaccaccgctttgatccgctggtattgttcttcatttataatgatggtccttccttcccgggagatatatccattgtcctccatctggctgatgcaccggttcactgtcttcacacagagtcctgtgctgttggacaaatcctttcttgtcagctgtatgcggcagatgccacggcgggaggatttccggtaaatctgcaaaaagagcagaaacagtctgtcgcttccctgtaaaaataaaaacagacgctctttcctgacctgctccagaagatagattcccatggccttcacctgttctaaaaccgcatggatatccgacagcatccagcggctgaactgatcctttgacacgcaaagaaaccggcagtctgtctctgtcatcaaggtggtccggtataagtcaaaacccatgaggaattccatggcaccgaacacctctaccggatagaatcttgtataatcgtaggtaatctcctgaacccggtaatccgtcgcctttacgatgccctccaccagaatataaatggtatcaacgggttcattttcatgaataaaggtggtgccttttttcagctttacgatcttaaatgcctccagaagccatttaggcgcgttggccagataattatttaaatattcccgcgactcactgcggagttcattgattaaggacatagcatcgttcacggtcttcctcctttcgtttcttcaccttcttcattttacctcatgatccattaaaaatcactcttatcttgcatctttttcgtatggctgtccgctggctttgggcgcagaggactttcctacaaacagaatcaggatcacgatggtaatgatataaggcagcatggccagaatcgaggaaggaactgcaaatcttccccctcccagggtaacggtaagggcctgggccgctccgaataataaacaggcgccatatgccccatgaggagtccattttccgaaaattacggccgccaatgcaataaatccctgtccgctgatggcggtaggcgtaaactggggaataatggcaagagtcatggacgccccgccaaggccggccaaaacaccggaagccaaaacgcatacatacctgattttatatacattaagacccatggtatccgctgctgccggatgctctcccactgcccggatatgaagtccccattttgtcttataaagcaaaaaccataaaaaaaccgctaatacaagggcaatgacgaccgttacatctacatttaaattctgaaacgcccctttgtttacgcttccaaacagcttgggaatcttatttggcaccggcagtgacatggtggcaccgtcaaaaagaagacggcaggcaaacagagccacaccgggaccgattaaattgatggcaatgccggaaatggtctgatcagccttgcatgtaatggaggcaacggcatgaagaagggcaatcatacctcctgccaggccggcagcaaaaaatcctgcccaggcatttcctgaataataaccaacggtagccccagtaaccgctccgatggtcatcataccttcaattccgatattggtaacgccggaccgctccgacaccactcctcccaatgcagcaaataccaaaggagtggaatacataagtgtaatgcccacaaacagcatcagactgttaagcatgtttttttcctcccttcgaaaaacggtccaccagcggcggaatgatacgggtcagcgcaacaaaaaatacgataacaccgatgacgatattgatgatttctgacggagcccctacttcatactgcaaggactggcctccatagatcaaaccgccgaacagcagccctgcaaaaatacagcccacaggagaactggctgcaatcagacaaaccgacaatccgttaaagcccgtgttttcaaaggccgccaaagtggcgattccgtgaggagaatttcctgtaatataaagagccgccgccaatccgcagatggctccggaaatgagcatggagtggaggatgtttttatttacataaatgcccgaaaattctgccgcactcttattaaagcccaccgctctcagctcaaatccctttgctgttttatagagaaggaaccagataaacaccgccagaatcactgcaatgaggattcccacgttcacatctgttttcagaacggtattgcgcaaaaattcattctgtgcaagggccgcctttcccgcttccgttgtcttgtaatttcccaaaatcatggtatagccggaacggttgatgggataggttccaatggtatccggcttgtgaaaccggtttaaggtacagatatagttagagaaataaagagcaatccagtttaacataatgctggtaagaacctcgtgaatgccgaatttcgcctttaaaaaaccggcaatcccgccatagactgctccggccgccactcctgcaaagatgaccagaggaacctggatcaccggcggaaaatcgaaaagaataccaaccacggtagatgccacgcagcccatgataaactggccttctgctccgatgttgaaaagtccggtcttaaacgcaaatgccactccgatccccgtaagaatcaggggcgtacttttaatgattacattggaaatgtgtttcggactggaaaagactccgtcaaataagacggtcagggaatgaaccggcggatatcccgctgccgccagtatgattcccgctacaatgaatccaaagaaaacagcgatcaaagtcattgtcaatggcttttttaaaatctttaccgttctatccatgattctttcctcctgccattaacagaccgattgtattttcatctacggttccctgggcaaacgtgtcctgaatctttccgtcataaatcactgcgatggtatcggaaacattcatgacctcatccagctcaaaagagattaaaagcactgcttttcccttatcccgctcgtttatcaaagtcttatgaaccgtttcaatggctcccacatcaagtcctctcgtgggctgtactgcaatcaggatttccggattcatggaaacttcccggccgatgatgaccttttgctgatttcctcctgaaagctccccgacccgtctggaaccgcagccctccgggcggacatcatattcctgaataatggttttcgtaaactcctccattttctttctgtttaagattccgtttctggaaaacggctctttgcggcaccgttccaatatggcattctcatttaccgtgaaatccagtacaaggcctctcttctgcctgtcctcgggaataatgctgacgccactgtctatgactgttctgggatctgtattggtgatcgcttttccgcagacagtaatgcttcccttttctgccggcaccaggctgttgatggcctcaaccagttccttttgcccgttgccgtcaattccggcgatacctacgatttcacccctgcgcaccgttaaattcagaccctttaccgcttccagcttcttctcatttttcacaacaagatccttgatttccaataccgtttctcccggctttgccggcgtcttatccaccacaagctttacttcatggcctaccatgagagtggccagctcctggcctgaaaccttttctactgacaccgtatcaatgtattctccccgtcggatgacggtacaggtatgggaggaggccttgatttcctttaacttatgggtgataataatgatggcttttccatcctttataagattgcgcatgatggacaaaagatcttctatttcctgaggagtcaaaacagcggtaggctcatcaagaatcaaaatttctgccccccggtacaatgcctttaatatctccactctttgctgcattcccacagaaatatcgcagatcctggcatccggatccacttcaaggccatacttttccacgatttccagaatctgtttcctggcctttttcatatccacaacacctgcccgggaagtggtttcatttcccagaataatgttctgtgtaaccgtaaaatcctccaccagcataaaatgctgatgaaccataccaatgccgtttgctatggctgtattcgggttttttatctccactttttttccgttgatatagatctcgccctcatcggcctgatacaatccatacagtacattcatcagcgtcgatttccccgcaccgttttcacctaaaagagaatgaatgctgcccttcttcacatccaggctcatatccttcaaagcgtaaaatgccccgaaccgttttgtgattccgtgcatctggaccgcataatcgctgcttatcgtggccatctcaatactttctcctttcattattgtccatgctttctggacataaaggtatacccgctgggtgtttcgcttatacaccgcaggcctttatgactcctgcggtgcaatttttcattcctattcagcgataaatgcctcgtattcctcttttgtggtgggcggtgtcagctcgccgtttcttattttgtcttccacctttaacgtatcttcataaacgccttccggcatgttgccatgctcctcaggaattcctacgcattcttcctttaagccgaaggtaagggtctgaccgccgatcttctggccgtttattgcctgctcagatacttcctgtactgcttttccaactaacttaagagctgatgtgagcacgttttccggtgctaaatatgcctgatcccggtctacgccgatcacccatttgtctgcttccttggcagcctcaattacaccggttcctgtgccgcctgcagcgtggtagatcacgtcacagccatcggaatacatccttgtggcaatggcttttcctttggccgcatcgctgaagctctccgcatactgcacggaaatatcaatatcctttccaagctctttggccgcatactttacgccggcctcatagccgtactggaactggtcgatcagacctgaggaaattccgcctacaaagcccacttttccggtctgtgttgtccgcccggccacatagcctaccaaaaaggacggctcctgggcacggaacataacacctgttacattggagggcgtatcctcataggcattgtcgataatcgcatactggatatccggattgctccctgccgcctccagcactgcatcagcacaggcatagcccactccccataacaaattggcaccgctgtctcccagtctctccagattcgtcacaaagtctgatgcctgctttgactcgatgtaattgacctctgcaccggtcttttcctttaactcggtgagtccttcccatgcagactggttaaaggactggtcattgataccgcctgtgtccgtaatcattgctacagaaaagctgctctttcctccggtagtctcttcctgagtctttgcgctttctgttttgccgcctccgcatgctgaaagggacaataccatcgctgctgttaaaccgaacacaatacctttttttgctttcataaatctaattcctccactttttattttatacaatttgtatattattaaatccgcatttcactgccagttccttcagtttctccatttgttccggaggcggactttttcttgtttccatttttccttttactccaaaattgcggaatgcaatgagcttcagcttaaattcttccagataaggtctgacttcatctgccacacccgcgatgacatcctccatatccacttccctgtcatctgcctggccagagccggaagaagcttccgcctcaagacatacaagccttacctcatgcaattttcctgtctcggccagatattttaaatttttcttgacaagccggttatctccgcctgtcagccggtgaaatacatgatagtcccaggcttttacatctaacatgactttgtccgttaccgccatgagctttggatacctggaaaaatccacgcagccgttgctgtctaaataacaggacagcccggcttttcctgcaagcgtaaacaattctgtgagaaattccggatacaggctgcattcaccgccagacacagtgatcccctggataaatggcatgtttctttcaatctgctcccatacttccatagccttcatccaccgcaccttaggcgatgcgtaattgggacagacccggatgcaattgtcgcactgggtacaagctgcctcatcccatatcacatttgtgcctgaaaggaataatgcgcctgcagggcactggctgacacaaataccgcagccgatgcatagcctctgtgtctccgggttatggcagtaagcgcaggcaatgttacagccctggacgaacaccgcagtccggcagccaggcccatccacaacgcttaagggaatcattttgttaaccggggctatcacgtcagcgccctgactttccggttctccagatgtgcattacggtagttatctccacccaggtgcacggtattctgaagcactgcttcaccctcataatatttttccatttcacttcgttttaccaaatatcctgtgatccggaccagatcgctgtctgatgcgtaaaagcttatatacttgtctcccagagaaaacgctccctttacaatatccagcattgctgccggattatttcttcccgtaggatcaaaggagaagatgtccgcacagcctgtagggaaaaacttgtggaacctggcactgtggcgaaggtggtcatacatgcgctccggctccattcctacgggaatccgcactcctgaggtaattccgtgatccgaatcaattcccacctgggcatgaagggcgaaatgatcgtcaaaaatttcagaatacagcgcttttgctccttttgcataatctgcaattacctgcatgatctgctctgccaagtcatctgcttcttcattgtggccatatgtcttttccggatcattcatcagcatatttgcacattccgccagccctacgaccccgaacatggcaaggaatttatctctgaaaataaagccttccagggaaaggaacgatgtctcaaagaaattggattcttccacaaggaaacgaattctttcattcatataatttcccatgcggtcaaggcagtcaggcaaaagctcttttaaaaactgttctctgttctctgcatttgcggccagttttggaagcacgatcctcaccagcgtgtaggagccgccgcccactggaagaatattatagcagctggatatgccgtaatcaccataggtatccttgtgcatcttatggttgcagacagccgggttggcacagtagagggaggtgtaaagcgcaaactctgcataggaatccggtgtaatatccctgtcatatttcagtgttaagttgggaacggcattctgaagctccttttcaagctttaaaatcagccttcccgccctggtctcttccggccctaaattggcatgacagaacccatcggttatggtccggtccagataaatgagaaacagcttcagcttcttttccgcttcctcatccgtcaccccgtcaagaaacggttcaatcagcttatcaatgttgccaagataaacgggataactggtgatggatgggacgtggcggtacagaatcattaaaaactgcagcacttcatccaggtctttcggcgcttccagctgtaaaaactcacatccgttttttactgctttttcataatccggcatcacatatctggggcgataaggtgcatgcccctcatccagatcgcaaattgctccaatgtccatataacggcgcgtctcttccggtatggaaagcacctccagactattttctgctgcatgtgcaagcgccacgaccttctgctcataagtcagtccctttgatgttacaatgtctaagatcttgttcatacattccacctctttcatttcgagctatgtccgccataaaaggacttatatctcatatgctctggaaataaagacattgtaacaattattttttattatcaaaaggactcatgtcctttttggcgaaaatattattcgatttgtgcattagtgatatttttactggcagaattttagtaaaatagtaacaatcgggtcggtcaccattactgaccatcaaaataaaattcacaagaacccgattctatggtttttacggccttttgtttttccccaggacgcagccttgtgatcaaaaaagctgataagctctctgtcgaaagcttatcagctttttgccgtggcaattctcaggccctgcctgctcatttggtcatatgatctcagcggcccattggcgctctcccgctttacttgtcaagagataaattcataatgattaccgtttgatctttatttccatagttttttttcactctgtccagttctgcataacccattttctcccagaacttatatgcgcccttattctcttccactaccccaattcttaatgccgcgccatgttcttgtgaaacccaggtttttataagatcatgcaatgttcttcccaaacgttttgctctttctttttggtcaatcatcaacaaacctatgatccattctccaggcactttataatcttttacaatatcaattaccccaattaaagcacctttctctttatatatcccaaaaacatatttgtcctttggttcttttcccggcggcaagtcaaataaaatactgtttgccgcatctttttcaggcggcctgccttcaattaactcaaaataatcggaacatcgttggcataagtcttgtaaatcagtctcatcatctcctgacagcaaccggatattgtattcctgctgccccattatgttctttcctatcaatatagatcatcctttctgtattcaggaaaactatcttaaggttgctgctgcaatatattttgtcatataatttacccctttctaaccatatcacaggccagccattaccccagaatcagcggaagcactgtaattgcaagagtaatagccccaccccctgcaatcacaaggcagctgacgctgtaattacgccacaatacctgatattatgtttcatattttaaaggaataataataagactttcccttttccgtcatctgccggatatccaccttaaaaatatcgctgatacagctatggactttgttgtctgaaacttcttcataagcaaccaccctcccattctccatcacggccagacggtcagaataattgagagccaggttgagatcatgcaaaaccagaacaatggtctttccaagcttcctgtttaaactgcttatgagctccatgatttcataggaaacattaatatcaagataagtcgtcggctcatccagaaaaatcaccggggtatcctgagccagtaccatggcaagaaaggcacgctggcgctcccctcctgaaagcctgcgcatatttttatttcgaagagagtcgcagcaggtcattttcatggcatattccgtcagccttttatcctcggcagaagaaaaactgactggggactggtaggggtatcttcccgacatcaccgcatcctccaccgccatgtccggtatgtggctgctttggagcagtacggatacatttctggcaaactccttcctcctcatgccgcctatctctttattctctaaaaacaccttcccctccctgggatgcaaaagtcgggaagcaagctttaacacagtgctctttccgcatccgttagggccgacgatggtggttatctttcccttttcaaagcttaaatccatttcccggatcagcggctgtctgttataagaataagtcacgccctcaagcctgatcataagctccatcaccccttccgcttgtttttaagaatcagataaagaaaaaacggacctcccataaaagacattaagatccctaccggcagttcataaggcaggaataaggttcttgccagcagatcacacagaataacaaatatgcctcccgttaaggcactggccggaaggacaaaccgattatcctgaccaatgatcaattttatcccatggggaaccagaagacccacaaagccgatcattccggcaaagctgactgccgcgcctgcaaggacagccgctatggttaagtaaatacaccggcagacgtttacattcatgcccagggcctgtgcactgtctgcgccaagatttaaaatgttaagtcctttggaagaaaacagtgccaaaagaaaacctgcagcaataaacactgacggataaacaagagcattggaagtcaccgaggaaaggcctcccaccagaaaatttcccgcgcctacataggcatccggatataaaatcataaccgtattcattcctgcgctgaaaatgctgttaatcacaaagcctgttaaaaccagcaggacccttgacatcctgccgaacatggtaattgccagaaccagcatacaggcaaggagcgcgccggaaaatgccgataaaggcaggaaaaacggatctgccggaagaaaagcagatgccagaagtaccatcagtcctgcccctgcattgactcctatgatattgggacttgccaggggattgttaagcacggactgaatgatggcgccggataccgcaagcgcgctacctgaaagcagggcacccagaactctgggaaggcgcacggtcaaaagtatccggtataaggaatcatcggtcttgcctgaagcaaatgttgcaataagcacagacggcatgatgttgctggctcccaggcataatcccagcataaccgaaaccgccaggcctgcggctgacaataggataagcagccgcgccttattatttctttccataaagaatctccgaaaggtatgtatagctttctccccatttctcgtttggtttataaaggaatttttcctttggcaaaagtatgtaacggtcatttttaacggcagtaaggccattccatgcaggattattttcaatgctttcctttaaatttttcatggcaagagcatcgtcatttcccatgggaatcacaaaaatatagtctggatcttcctttacgatgctttccatgctgaactcctttaaaaggctctgattctcatcagctatattctggcaccccagatccttcagcatctttcctgtcatggttttggaattctgcgccaccgctccgccggaataggtgatgagaagcaaaacagaaggcggctcctgagcctttgcggcagaaagggtcttctcaatctctttctttactgccagcccgtttttctcatacagctcattttttccggttatttccgtgcaggttttcagcatggataaatagtcctcaaagtatgtcactttaaaataggccgccgggatgcccgcctgctttaaaacctctctgagcgctccatgttccttggtttctgatgacaatatgaccagatccgggtttaaggctatgattttttctacattgggactgttgtatttccccacggaaacggtttcctccgaaagctccaggcccctttcatcaaacgcatcatccgtaactcctgtcagactgcctccggctgacagccagatctctgcaaaacttcccatcaaagcgaccacgcgctttggatggtcaaccgttacttcctgaccaagggcatcagtaaagcggtacccttccggcgtcccggaagccggttctgctgctctgctgccgcatccggcaagcatatttaaaatcataagaagcatcactgcatacaccatagtttttatcttcaattgaccaacgcaccttcttcgcataattgttttccataagcacaataactgtcttccgccatataatccccgtcattataatatcctgcacgtgcacggcatcccccgcactcttttccgaaaacgcagtcactgcatgtccccttgtaagcctgggtgcgcagagttttaaacagactgctgtttttccagatctcgccaaaaggctcttttcggacatctcctgcttcctcaaccatataggcacagggacggacctttcccacaggacttaccacacaataagaaagtccggcaagacagcccctggtaaaacgggtatccacctccatctgctttgccacccgtataaactgaggggcgcaggtgggcttgatatcaatgggtacctccttttgcttggccataatggtctggagaagcttttcgtattccatgactttcaaagaagtttcctccagatatatccctctgccaaccggaatcaggaaaaacagataattggcggaagcaccggatctcacaccgaaatcaataatatcccccacttcatcctgattccagtccatgatcgtcgtatgtatctgaaagggcagaccggcctttctgcagttctcaattccctccagggtcagccggtatgcattttcatctcccctgaatttgttgtgtttttgttcatccaggctgtcaaggctgattcccatggccgctgctttgcactccttcagctttttagctgtctcttccgtgatcagcataccattggtgccaaagacaggacgaaggccagcactggctgcataggataccaaagtataaatatccggacgcatcagcggttcccctccgctgaatatcatgatgcgaaaaccggctccggcaatttcatcgatcagctttttcgcttcttccgttgttaattcatttgcctttttattgccggcatcctggtagcaatgtttacacttaagattacactggtttgttgtcatccacgaaactatcatatgcattctccttgtattatactttaaaccatttaattcatcataattacaacaaccctttttcattccacatatttttaacctttaacggctttatagaaataaaagctgtttttatcaccttttatgagaagctaaaaaagagcttcttataagctatactatcataaatttcctggtttttccatattaattccagcctcacaagcctggaaaaccaagatataatatacttgaaaaacaggcgtaattttacagtatttaataaatactatcaataacacatccgcattcgttgtaattacaacaaccaaaccagaaatcacatgctataataagcgtatcacaccgacttgaccgttatcacatatagaaaggaaaacaaaatgacacattatataaaaacaaccgataccatctttgatataaccgaaaaataccccgaaacaatcggattatttgttgcaaacggctttgagcatttaaataatcctgtcatgcgcaatacccttggaaaaactgtcaccctggaaatggctttatccatgcgaaagctcaataaggagcttttcatagaaaagctggaggaggtcattaatcaaaatcttccaaatctcacttccgggctcacgcctacgagaaaggaagacggcggcgatatccgcattgagggcgtactgccctgccccatccgccttccccttctggaaaagtttgaggtctggatggaatcccaaaaagatttcatggactataaggtagactacaatttaaaatccgccaaccttggactggatgatgtaaaggaacgggtcatagccgcagacggcaatgcagacgccttatccgacctctatctgtcggctggctttgacttattctttgataaaagcatgatgggacgttaccgggatttgggtgtatttgaggatatttcagatattaagcaaataaatcctgattttgacaatgagtccatttccttaaaggaccccaaaaaccagtatgccatcatcggcattgttccggcggtctttatggttaatacggctgttttaggggaccgtccttttcccgaaagctgggcggatctaatgaagcctgaatttgaaaacagcatcagcatgcctatgaaggacttggatatgtttaacgcatttttgctgcacatccaccggtattacggggatgagggcattacaaagatgggtaaggcccttttgcgcagcatgcatccggcccagatggtaaaatcccatattgcaaaggaaggaaataaggtcccggccattacggtttctccctacttttttgccagcatggcagatgagaaaagtcctctgcgaccgatttggccaaaggatggcgcgatcatcagtccgattttccttttggcaagatcaaagaacagggaaaaggtcaagccatttgtggacttcctctattccagggaaataggagatatactctcctctaacggaaaattcccttctaccaatccgctggtggataaccacttaaagccggagcagaatttcatgtggcttggctgggattatattcacagccatgatatcggagaactgatcaaaactacggaacagctgttttatcaggcagcagaaaaggagattgtatgaatctgattattttttcaggccccccttcctccgggaaaacgtctgtgatcttaaaaaccattgcttcttttcagaacagaaatataaaggttggagttgttaaatttgactgcctttatactgatgatgatattgcctacgaaaaggccggtataccggttaaaaaaggactttccggcgccctctgccctgatcatttctttgcttccaatattgaggaggtagtgaattggggcaatgaggaaaagctggacttgctcatcaccgaatccgccggtctttgcaaccgctgttctccttacttaaaggaaattaagggtgtctgcgtcattgacaacctatccggcatcaatacccgaaaaaaatcggaccaatgttaaaatccgcggattatgtggtcattacaaagggagatattgtctcccaggcagagcgtgaggttttcgcttcctgtgtaagctccgtaaatccccgtgcagtcacaatgcatgtaaacggtctgaccggacagggcgcctatgagctgggaagcctcctttatgacgagaaccagaacattgaatccgtccaaggcatgcagctgcgcttccccatgccttccgccctctgctcctattgtcttggagaaacgaggattggagaagcatttcagatgggtaacattaaaaaaatcaatttgggggcagataagacatgatggaattaagtttagaccagctgcttaaggaatatccctttgcaagcgcgtattttgaacagaataagctggatattaccgggtatggggataagaccttccaggagtatttagagcattttacaatagaagaactggaagatcaggccattgacaaggaaaagctcctgtccaatctccctgtctacgtggatcagatgagtgcgtttctggggctggaaaagagcaaccgggttctttccatgacaattctggcaggatttgataaatcaggcaatccggagggcttttcagagcttacggtggaaacctcacaaatcatttccatcgtaggccctacggggtccggcaaaagccgccttctggcggatattgaatgggcggcgcaaaaggatacaccaacaggccgcagcattttgatcaacggagaaaagccggataataaatggcgtttttcctccaacaaccgactggtggcacagctgtcccagaacatgaattttgtcatggaccttacggtagagaactttttaaggatgcacgccgtaagccgtctggtggaaaatccccagatcgttattgaacagattattttagccgccaataatctggcaggagaaaagtttgacttaaccactcctgtcaccagcttaagcggagggcagtccagagccttaatgatcgctgatacagcaattttaagctcttctcccattgttctcatcgatgaaatcgaaaatgccggaattgaccgaaaaaaagcgcttgagcttttagtctcctctgataagatcgttttaatggcaacccatgacccccttctggcgcttatggctgacaagaggatcattattaaaaacggcggaatcagcaaggttctggataccagcgaggaagaaaagctcttattagaagggcttgaaaaaatggattccctgatacaggctgcacgtcaggagctgcgtaagggaagtaccttgtctgcagacattctggacatggaaccagcattataattttatggtaacatttcaggcggcggatgggtcagacatccgccgccaaatcagacatattccggacgaatcgtcatgcagagtcaaccgctaaccatccaatattacgatcttcatttttccttttctcctgtcctgctgccggaaatttccgttattttttaacaagttccatatggggttatgaaattaaatggcaacagtatttctttaaagacaaaaaatgccttctccgggattattcggcccggagaaggcatcagatatgttacctctgtatcaataaattctcacttcaaaaatcgttgcttccctgctgccatatgtggaaatggccctgatccggacggcgtctccttctgttccgtcaagatatagctgctgaagcctctggccctgggactgagctgtcatgtgattcacaacctttccctccaagagaatctccacttcatactcctttaataattccggcggcggccctgacttctgtctggacaacacgccctggtttatagacggggtgatctctctgcttaaattggagtccagaaccagacgtatttcctggattgtctttttctccggcagggaaagaagcagggacggacagccctctataggagcacgccagcagtttgactctccctccactgttcttgccactccgtttatcaccttttccggctcgcctcccgggatatggcaggcagctgtcaccgccgcctgtctggcgtaatcagcaggatcacggttggcaacaaagggaatataacagccatcctttaaaagctcctgctgaagctctcccacacaatccaggacctctcttggccccagattccttgttactgccatggaagcggccgtaccagccgcctggcccacgaccgcgcaggttcccatgacccttgtggatgaaaatgccacatgggaacagctgatggccctgcctcctaaaaacaggttccggatgttttttgaatacaggcagcgatatggaatggaatatatgccgtttacctggttccagaccgtaggatcatcgctctcatttaaaaagccctctaccgtatggatatccatgggccagcctccataggctacggcatcctcaaaccgggtgctttccaggcaatccttttctgtcagaacataatcgcccatgagccggcggctttccctttttccaggcagaaagcccacccattccagctccatttgctccgctccatgatctccgccgtttttaatatgatcccatacgccgaatacagcttttaacagctcatcccgaagttcttccccgtgggaaatcacatcccgttctccgccccccagctcgatccaccagtacccggaggtgacatcgctgtggtcccgcagtctaagctgctcctcggtataggtattggcccagaagggctttataaagggaacctcgtgccccatatccctggccttgaacatgagggaatttcccatggtataggggtcctctttttccggagccagggattctccatattgggaactgctctctcttccgatccggtactcagctcccgctttagcccccagcacaccgtctcccgttgcatctaaaaacatggtgccgaaaatgcagaaggatttctccgttgtcatctgcagggcgcacaccgcttcaatcttgtcaccatcacacaggacctgggtcatatgagtatttaaataaagagtcagattctcctggtaatggaccttttcccacaggacggaatcaaaaatcggatataccatctccgggtttctccgcttgttttccaaaagtatttcttctaaaatcccggattcccgtgcatttggaaccgacatgtgatgatccgccccgcagatgtgcatccggatttcagagcttgcattgccccctaacaccggcctgtcatgaatcagggcagttttcactcctcttctggcggcggcaatggctgcgcagacgccggacataccgcctcccactacgacaaagtcataatgatgggttttcacggattcacccccaattccatcagacggctctgaacctttttcacttcaagggctctgggcaccattccggaatcagcgcacatggctgcggcaatacccactgcctgccccatattggcgcagatgggcatgacgcggtaattggaatgggccatgtgggttcctgaaatgtttcttcctgccagatacagattgtcaatttccagaggcacaaaacagccgtatgggatggtgtacccttttgtctgtgggaaatgcttttgacatccggtttcatcaaggccgttgccggtcaggttgtgcacgtcaaaattaaagctggcctttgccactacccagttgtcaaatatcctcgcctccagtatatcctgctctgtaatggtctcttctcccttaaaatgcctggtttcccggattcccaccagggaggcggagctgataatataacaattttcaaagccaggaacgtatcttctaagaaagtctactattttctccatctgctctctgcagaccagggttgcctttgtaagatcctctacacttgtgccgtccactccggtgcagttggtcatattacaggtaaccactcccggaagcgttgtcttgtataagagcacatgacccgctggactgggcagatatcttttcccaagctcctgtaaatccccgtcaggaagggcaaagctttcttcaaaaccgccaggaaaaacacctctttcctcctctacacctgccaccttaaacatgatcgtagccggctgcatgaggccgtcgccttctcttcccttagaataaggagcgccggcctttgccgctatatccccgtctcctgtggcgtcaatgacgatctttgcaaggacagcctctctgcctgatttgctttccaggatcactcccttaatcacatttccttccataatggcgtcgctggcaaaggtatacagccgcaggcaaactcctgcttccgtaagcatgcggagaaaaactgtttttaagcgctccggattgatgatctgccgtccctctccggtaagctctgccgaacggcttaagatttcctcgtaaaatccaccttcggtttttccggtccagtggctcataagcccggccgtggcaattcctcccacatctcccgtctgttccgcaagcatggttactgcgccttctcttgcagccgcaaccgccgccccgattcctgccgggcctccgcccagcaccagcacatccacttcgcgtattacagggatttccctcttattttctgttatatatttcatattctcaatcctatcctttcaccgcaccggccaccaggcccttgacaagaaacttctgccccagcaaaaatacgaggaaagccggaatcagggcagaggctgccgccgccataaccaggttgtattccgtcacactttcttcaataaaattcgtaagggcaatgggaattgtatacattctccagtcgcttaaaaataccagaggctccagataactgttccagttccaaaggaacaccaccattgcaagagacgccatattgggttttgcaatgggcaccatgatctttaaccaaatgagaaactcgtgggcgccgtccacccttgccgactccctcagttcatcggggatctgcataaaatactggcgcatgagaaatgtgcctgtgatggtaatcagtcccggcaggatgagggttaagtgagttccggtcagccccattttgttgaacataacaaacttgggaatcagcgttacctggctggggatcatcatggtagccagatagatcaggaacagaacatttcgccccctgaactttattttggcaaaggcatatcccgccagtgtgctggtaagcaccgatcccgtcagattgatgacggcgatctttatggagttccagtatgccaggccaaaatggtaatcccttgctgccaggccccccacattccacactttcttgtagttatccggataaaaatattttggtatccattcaatcggcagcttcatgacatccagcggaagcttcattgatgctgagagcatccataaaaacggggtaaccatggagacagccagagcccctatgactacggtaaacaggacccttaagatgatccgttgatattttttcattccatccgcctcctttcctctctatagcccatgccttttgggcatacaggtatacccgcagggtgtttcctctaatagctgacccattttttctgccctgcccattggaacatggttataccaaataaaatcaagaataatatccacgacatggcggaggcatatcccatcttgtagaaggtaaaggctgaagtgtaaatatagtaaaccagcacattggtggccgttcctgggccgccccttgtcatgatctgtatgggcgcaaacacctgaaaggaggtgataaacgttgtaatgatcaggaaaaaggtggttggtgacaaaaacgggatcgtaagcctaaaaaacttctgaacttcatttgctccgtcaatgtccgcagcctcatacacatcctggggaagcccctgaagtgctgacgtatagatcatattggcatatcctactcccgaccatacggtcatgagcatcaacgccggcagagcccaggttgtgtctccaagccactggggagggttttccaccccaaagaactttaccaactgggtgaatggtccccagggggagtacatcatcacccatacaatggcaaccgccacaatattggatatatagggcataaaaagcgccagcctcatgggaagtctggcaacgcagtatttatcgatgatgaccgccagcaccagtgccaggaaaactgtcaccggcaccactcccaccgcaaaaattatggtgttaatcagggaactggtaaaccattcatcctgccacatttcgacaaaatttataagtccgataaagttccagttgccgatccctttggtataatcccagtccgtaaagctgatgatcagggaaaagatcatgggaaacagggtgaaaagacatacaccgatgatattaggcagtatgaaagcatagcctgtcaaatctatttttaactgtttgctaagcctgattttcttcatgatcagcggttccctcctttcttctttttttctcaaatatttgagcatccaggtacacccgaagggtgtttcttttttttccccggggctgccgttttctttgcggcatccccgggaattttgcctctgattatttttgcaaaagctcatctgcccttgctttggcctttttcattccatcttccactgactgctttccgataaagataccttccagctcctcgactgcgattttctttacctccgcaatatgattggtaatggatggaaccgcataattctcggctggtgttatgagtatcttctgggtggtttctgcatccagataatcctctgctcccatgacaaacgcctcggtcacttccagggcgttataggtattggaagcaggcacacgtccgccttctaccacaggaagcattccctcggttgcataccactttgcaaattcccatgcagcgtcaatgttctgggattttggattaatgcacagatgatctccatagccgccctgggtgtattttctctgtccctcttccaccaccggataaggagcaaatgccgtcttaaagtcatgaggatagctggcctgatctttaacgcttcttacaatccacggtcccaccgtcatggcggattttcctgtcaggaacatgctttcctgggacagcttctgggttacggaatccgtatgtgtaggagatgttttatccacattcatcatattattgatcagctcaacggatttaagcaccaccggatcgtcaaagctggtttccttgtcacttttatacattggatctccgccgttggtctgggttgctaaatagctgaaaaggtaggtcagatcctgctgggaattccagaacatgccgtaaaccttatcctgaccttctccatgagtaagctttttggctatctcccggaattcctcaaaggtccattccgtgggaacttcgatcccagccgcttcaaacatgtcttgatttaatacgattccgtactgatccagctttgtgggaatggaataaggcttcccgttaatgtaatatgcttcggccagagttccaaaatattttgtcagctggaaatcatcccgggcaatcaactccgaaagatccagcgccatgtttccatccgcccgctttgtcaggacatcggtggtgtaggtcatataaagatccactccgtctcctgagagaagattggtttccaattttaaatttcctgtatcatcatttacaaaccgctcgtactcaacctgaattcctttatccttgtacagctggttgaagttgtcgcaaaccgcctgaggcccggcttcagccggaacgcctccccacatccgcaaaaccacaggttctccgttacctgcttttggctcctctgtttttgctccttccgtttttgctgtctctgccgacgtagtcacctgttccgtcttctggccgctctgacagccggccagcactgacattgccatgagagatgccatgccaagtgcccctaattttttccactttctcattgtatcttcctccaataattttgatttagttcccacatatgcctttcggagatatattctatccgccagataatgaatggcatgcttaaactataacaactgactatactatagcaaaaacagcaggcaagtgatatctctctgcctgctgtctttcttccaattttttcgatttacggctctcttgattcctcttttttgtcaatgctctaaaatcctgctgtttttctttcaaatcctgctgtttttctttcaaatcctgctattttcctctgtctttttcaatcgtgcctggcggtattccaaaggagactgccccacactctttttaaactgtgtgctgaaataattgggattaacaatcccaacctcatccgcgatctcatttacctttaaatcgctgctttccagtaagtatctggcatgctccattctcacccggtatacatattccaaaaagctgatcccttcctcctttttaaatacgtgagaaaaatagcttccgctcatgttcaccatggcagcaatgtccgcaacctgcagttcttccttcatatggcttctgacaaagctctttgcctcggcaacctcttttcgcaatatcctgccgctgtttgattcatactcctttttatactgctccaccagctctaatattgattgcctgattttttccagatacgtataatcattgatggaagtctccatatttattccgtttttatctaaaaacatgtcgatgtcagctttgctgcgggcaaaggaagcggccagagctccataagtctttctcagtaaatagcggatttcctccggctcccaccggttcttttcttttaaaaaacaaaaatattcttccatgaattttctgatcccgtaaaaatcgtgttccgctgccagcccctctacaacagagctgtgaaattcaggaggaaggacagccctttccctgatggttttctcatatggatgaagttttccaggctccgaaaaaaagcgcattttcagggtatcccggttctgggcaacggcatcttttaacccctggattcccgtacgttccctgctcaatgctccgctcacctccagaccgtaatactgcctggcacagctggcaaagattccaaactccttttccattgacataaaaaaggcctgatggtcctgaccttcttcccggtttacggccacggcaaaatcatattccccatactggaacacctccgcccggtgatggcgtccaaacagctccccaaggatattatccatggtaaagatcagaagctccaaatccatgaaatcccctttttttctcaccaccttaaaatcatcgatggtaacggagagaatgcagaagggccggtcaaagcttatggcaagaggcagctttgtcagctcctccaaatatttatttaaaaaggtttctgagtttaagatccttttaaacaatcccttttttatgacttctaaattcctttcagccagggaagtggtttcctgggccgtctctgtccctttcccaagggaagcggcctcatccatgaccttcagcagctcctccggctttaccgtcaatttaaaaacataatcaaaagcccccattttcatggcacttcttacgttgtcaaaatcattatagctgcttaagacaataaactggatgtgaggatacttttccctgcactctgaaatcagctcaaagccatccattgggctcatctttaagtccgtgagaacgatatccggctggtactgcctgatcttttgaagcgcctctgccccgtccgatgcgtcacagacgatccggtatccatggttctcccatttgatcaatgactggattcccaggcgcaccaaaacctcatcatccacaatcattaccctcttcatcccctgttttctcctctctgattaccggaagggtgaacaataccaccgtcccccgggttttaaggctttctatggtcagcccatattcattgccaaatgtaatccggatatactcgtccacatttttgattccgatacctgtcagcttgctctcctttaccctgccctttcgggaggcctcaaactgcctgatgacattaggggaaatgcccactccgtcatcctctacatagatattaaggctgccctcctccgtaaacccgtaaatccggatcaggatttcttccctatccttgtcatatccatggataatggcattttccacaatgggctgaaggataaatttagctgtttttaaattcatgatatcttcttccagatcgatttccagcctgcagtggtttccataacggcagttctggatataaagatagtttctgatattctccacctcttccgccaccgttaccagacagttttccctgctcatgctgtattttaatatatgggcaagggcgtcaatgccgtctacgatattatccgcccctctgataatcgccatccagcggatggttgacagggtattaaacagaaagtggggattcagctgtgcccgaagggactcataccggtatttttcctttacctcatgctcatttttaagctgttcaaacaaaccgctgatgttcacggacatttgccggaaggaacggttcagcctgccgatctcgtcagaccgctccatatcaatatcctttaaatccatgtccagcgtataattttccatctggccgctgagttttacaatgggctttaccagcatcctgatggataaatacaggatcaaaatcagcgcgcatatgacgatcagtagggtcacgttcatccggaacccgatcaattccatctggttggtcacttcctgataattggtaaagtgaaagaccttcatctgctgttcgttaaacacccagggctttggtatggtgtaatagctgatgagaaaattccctcctccggtctggtaccgtaagttcccgctttttttctccgccgtctcccggtacaggtgccttaaatcctcctcatgaataagtcccctggtgtcattttgcaaaagtacggttccttctcccacacagacatatgctatatcgcctgcataggcgtattccatcaaaaggtcgctgaattttttctggtcaatgctgataataagagttcctatgacgtttcctgtggtatagtccttaagaagagattttgccagggaaatataggtctggtctttctgttcaccaatgatataggccggattaaacatggcccaaacaatatgcccgttattctccctgctctttttcacccaatcctgatccagtagaaactggtaatcctgataattcatgctccagttggagtaaatcctgtcgtaatcgtcaaacaggagaatcttcatatcctgaacaaaatcaaacccgctggcaatgctcagtttatgtaccatctggtcaaagtacttggtattgtcatattccgaggtattgggatctgttatgcgcctttgcagctcctcgtcatacacaaagacattggtcagagcggctatgttctgtagattatcgcagatattccgttctccccttgagatgttctgaatgactttttcactcagtttttcctggataaaatgttccatactgacccgtacgtaaatacagacccctgccagaggcatgaccacgcacagcagaaggagaagaaacatccgaactgataatttagaagactttttcatccctgttcctctttctgttttcatttaacctcatcaagtaaaggtgcaagccccttctgacatgctgcgacagcatctatgcggttatgcccgatgaagcggggtgtgcagtgacccttggtcattgcgaatatcccattgactaaacttctccatgtatacggcgttatggcatccggaaacatggcaatttttattataacaaatattttattccctgcaaagatgggcatttttttaaatatgcagatttttagcaatttttccatggcattttctctccatatgggatcatatcaatcagttttatatgggatttatataaaaacagctgattccatcagccttaaacctgtgtttcaaaaaataaatataccctgatggcagaacacaaaaaaatgattttgtttgtctatcagggtattttaatatgggtggaaatgattggaaaatatctccgggaacaaatagcagatttaacattaagaaaccagaacttttagaaatcaggtaatgtctcttctaaactttatcattcaataaaaccatatggacatgatcttcccatatcccgttgatctttaagtatttgtgagcgattccttcattgtaaaaccccagcttttcagtcactctcaaagaacgtttatttttgggcattacattggcttctatcctatgcaatccgtattggttgaatacaatatcaattccttttttaattgcctccgtcatatagccccgattgatctcatcctgatccaatttgtagccaaggtaacaggataaaaaagctccccgcacaatattactgaaaccaatcgacccgataatcctgttctcatcagtctttttaaaaatccacaatcttaataagttcttattttgtatttgaaacagatcgtttttaagctgtacttcatggtatgccttcgtataaaacctctcacttctgacaggttcccactctcttaaaaaatccctgttcctcagataataatctaaaaccatgtgcgccgaagatgtccccagtattttgagaactaatctttccgtttcataaatccttttttctatcatgatcttcttttgttattctcctcacaaagctacccgcagcaatccgctggcttaggcgggtcatccaacttccgacggaaaacgctgctccggcttttttattagtcaatcaatatcattccgcctttgcggctaaagccggtctcccacaattcatgaaaagacagccagtgaaactctccataagttgcaatctttacgtaaaattcattctcaaattcttcatatcccacaagcatgaaccagtgccagaccagatctttaaaattaacatttttatgctgcagcagcaaaaaaggaatggggattccgttatcaatctgactgattatttttctggccgcttcctttaccggagtttctcccggacagcctgtcagccggatatcctcgtctcccacatcttttaaatattcatagaacccatctataaatatatccagcgtatcaattccatgcatacggggactgagatacggtttcattactttagaaaactttatataatctttcttgtcaagccgttggatatcatagggatacaggtgggctttattgtcatgaagtgccatattaatacaggaatcacatgcagcggcagctccgcagccgcctaaatgcatcataggatcccggaaccagctttgatttccgccaaatgaattttcaatagtgaaataaggtagttcatttttcatttttttcctccttgctaaatttctattataggagcattatagtaccagtcttggatttcgtaaagaaaaatagttttccccaggttatggaccgttcaaattgctgctaaagtacaacgctaataatgggatatattaatttatgtgagatgaagaatccatatgtttctatagaaaggacatgaaggttttcaccctcatgccctcaaattcaacacatttccattatatttttcttatagtttgaccgttattcatgtcatcagtgttatggattccacatgacataagaataaaaaagttcttatgaaactggtgattccccggcaaaaattatgttattaaaaaacaggcctttaaaaccgcctgattcctcaatgggaagtccttaccctatacttattatatcccataacgtttacaaatgcctgctttgcagctctgaattaagctttaaagcaggacgcacgccgtcacgggccagactgacattggcataggtccggatactgcagaacagcctgtttcttttccttccctggcgatataattaaccttgttggctttgtcatacacatacaagctgcatccgcctgcttcaaccaaatctggagaaaaaatcagaaaacaaatgatcctgttccggcttgtgggtgacataacctatggctattttattgtttgtaagttcaatcaatttttgtgcgccttcttctccaaacgctccgcataattccaccgccccaacgccttctctttctaaaaagacaagcttatcacaagcctctttaaaatttctgacagtaaaaacataactgacctgcttttctgtttcaaaacaagcctgatgcacctccggatcatagtgacttcccatcagtaaaaatgcaaactttttcttcatgttatcctctccttatatagatgattttttaatcaaaacccctgctttccattatgctgaaacagaatatttttcaaattttaatggcgcaaaattttatccattttcttgccttttgacaactcatctactaatttatccaaataacgaatttcccgcattagggtatcttccatatcctccacccgtatgccgcagataacgcctttaattaaaagtcttgatggatttaaagccggagcttctgaaaaaaaggtttcaaaatccgcgtctttttctaattgaacctctaattcatcctggctatatccggtcagccagcatatgatttcatccacctcgtcttttgtgtggccttttctttcagctttagccacataatgaggatacacacttgaaacactggttgtaaatatgcgatgtttttccatataaaacctccgtattgaggactgtgttaaatgccagcctttattatatctgatttcgaattaaaagtatagggctgtatccctattctcttaatctacaattctaacaaataataatctgctttgcctgcgatcttccgcaccaagttcccgtcaaaaaatacattttatcaaaagcgagagcaaaaaatctcccataagactgtgaaatcagtttccaataaaatcctcctgaacaacataaaaataaggagcttcacaaaatgtgacgctcctccgaaagaatatgatagtgatgaccccaccagcaagtcctgtcgccggcctcagcacaaattaatttccacactgatttatgttggcttaagagatattctaaactgcatacagaacatattcggtcgggaatattgtagatccataatagcgtatataaaagttgtaggaaggatccacatcataaatgatgcgggccaatttccaaatatctttgtgattatggtatatgcttagagcgaactttggatggccttcccttatttttgccagacagcctaaaagggcctcctcttctccgccttcaatatccattttaataaaggtcacgttttcttctatatcatcatctacttttgtaattggaacagctatggctcccttatcagacaactggcttatggaagataaaacgttggaagaaagatacatcgtaccgtttctattgcttgcgcccttttttctaataattacatcgtcaagcttaaagagctccacattcttttctatatattctatattggcaggtactatttcatagcagtacatccttttatagcagttttttccgaaaacctttgagtaattaacaacggtatctcctatatatgccccgatatccacaaacacctcattttcatcacattttacaatatcaaggtcaaaatattggctgaatgttttttcatatatctgcccaattcttttagtatccgacataagccagtaacaaagtatattaacaagtattcgttttgagcggtagtctttaagaatattataaagccattcaaaatcttccctgtgttcaacaagtgcatgggccctgttttctgcaagttcaaaatctcccttttccgggtaataagtccccaaagcttatgcagattaataaaatttatggaactggtatatagccggttatctgtcgcactgaagtgtcttaaattctgtttaacagcttccgtcatttcaaaaacgtctttttctttaatgtaatccatgagacgttcaaattctatatcgatttggttcggactatgtgataaagataagccgcttatattacctgggcttttaattgttaaaggttctgattgacaggacatttccccatcatcctccttaaaattttctgttccttttatcatatgtgggttctggaaaaattgtgtaattgcaggatctgttgacacaatggaatacccaaaaagatgcccgctgaatctgccctgtggtgccggaatatgtttctatcaaacatacttgtggatgcaacttatactcttccttaaaacaaccttcaggaccttaacttaaaagtcttatgcccgcttcctttgtttctattttatgattcatccggctcatcctcaaagacaaatctggcattgcacttataaccatgacaaaaatttcgattggaggattgtgccgtccagcaataaggacagcagattccgcctttcaggcgtgtttcaaatacagcagcaggaggggagggcatcggtttatttgcaagttccaagagatgattctggtaattccttttaaggtcattcatttcttcccagtactttttactcttactctccttgctgcacaaaatctgttcatatatcatgtttataacgattccgacggcaaccagcactcctccgatcaatgttgtttctgggtattcaatctttgtgaatatatcaattgcaattcccatgaacacctggcccacaaacgttaaaagcgtcaaccggaatgcagttactttaggaaccgttacattacacaaatatacggcggacacaccaagtacccctcccaaataaatccacagatccggcaaaggtgcctgaaggattaatgatatattgctttttccaaaaatggctgcgattgcaactgcaatcggaagccctataacatggtttatgaatgaactctgcagctccccactgtgccgtgacagtctcgcatttactgtccgtgaaaggacgattgtaattcctgcacagaaagaaaggagtaccgcatacagtgctgtatccacggaattgtccagcattacaaaaataccggccagcgaaaaaatgagaccaaaagcagatgactttctgaataaatgctttttcatgccaaagagatccagacagtcaattaacagtgaagttaccgtctggccaaacagccccagggctacgatactggtcaagctgattttcccgtaggcaaaattattaaaaactgtggtcaaaacaccaatagccccgcccagatacaaccagaccggcagatttttctttacggcaatctttttctttgtcagcctgcaaagtatgtatgcaaatacagcgcctatgacatgaatgattgctgccgcaccaaaaacccccatagaagagtaagcctgccgttgaccgcaaccatcactgcaataactaatcccgttaataacgatagtatattatacatataatcacctccgtaaggccattgtataatacaaattgacattcccataggacatatgtcatactgataatatgataaattctgtataacccgggggaggacataaatgcaaagcagccgtttgaaaaatgagcatcttaagagattagaaggatatggtataaaaaatatgattctggatgcaggcttatgcctgaggtttaaagccggtgaaaccatttttaatgaaggaatgccaatttcatattttttaattgttgtaaaaggaagggccaaggtttgtaccattgcaaaaaacggaaaagatttagttttgtgctattacatttccgatggaattataggtgacattgaattaatgaccaatgcctcgattgcggcaaccagtgttatcgctataaccgattttgaatgcattgcattaccttataaagaatacgccgttgatttaaaaaacaatcttgcctttttaaacaggcttggaagtgaactttctattaaactattgtacagttcaaaaaattatgtgttcactgccctgtattccggagaggaacgtttatgctcctacattttagagtcttcgcataataacgtattcaatgacgtgctgacagatgtgtcctcttcaataggtatgagttacaggcatatgttccgcctgctgaaccagctatgtactgacaggatattggacaaaaaagacaatgggtatctgatccttgaccgtgatgaattgattcgcagatctgctgattctttttgaatggcaccataggcaaactgaatacagtattcaaaggttttaaatatgtgtgcccggaaaagaagcccggtcagacggtcttgtatcccttcgtcggaaggaaattatttatttatccgttgatatttagcatctttcatgttattctttgactatcttatttgaatggaggaattgcgtgtgttgattttatcccgataaaaaaagtaccaattaacagaataatcgggattggtctgtccatacgtgatgccttttataatacgtatcagtacaattgcttccctgctattaaaggggggtgttatttgatttgtattttatgaattgataaaacagacttttccgattatcagtacaggcagctatatgtctgtacttttacgtttcttcttaaaggagtgtttttatgattaaaacagtaacgtctgaccaagtttcactttacacggaaagcttcggtaatccggatgatccgccaattcttttaattatgggcgcagtaagctctatgatatggtgggaaacacctttttgtgaacgattggctgaagagggattttttgtaatccgctatgacaatcgggatacaggtaaatcaacgtcttatcctcccggaaaaccggaatatactttcgaggagctggctgatgatacaatcgtggtactggatggctacaatatcaaaaaagcagttattacgggaatgtctatgggcggtatgctgacacaaatgacagcactgcgccatcctgatcgtgtttgcggcattgtactgctgtcctccatgtattttgcggaaggtgctgagaatctgccttattcttcagatgaagtgaatgaattctttgccatatttgggcaaaaaattccggtcaataatgaggaactcatagagtacacaatcagccaatggcaggttaccaacaaaagcagccggccaaaggatttggagcacatcagggatatgatcaagacggatattgaaagagctgccaactatgccagccgcatcaatcattcctgtgcccaggtaaccggtaacgagcttggccggatttctgaaattcaaattcctgcactggtcattcatggtacggaagatgtggtcattccctatatacacggagtaatgctggcaaaaaccatcccggactcagtcctctatacaatggaaggggccggacacgaacttcatccacaggattatctaccggtggcaagacagattaagaaccggtttttgcagtaaaattaattagataagcttttaaggcatcgctccttgtacgattcattcatttacaagcgagtatcttatccccctgtccttccgatcctgaaaggcagggggatcttttatctacttgcagaaccttttaaatcttatccattgcctttgtaaccttcaatagcttaccgcaaatcgttgtatttttcatagcttccagtaccaatgggcctttaccgtttagtatttctatataggtaagggtatcttgaatacttatgattccaatatcctctgcctcaacaccttccagattggatatgactccaacaaaatttgttgctctgagcttctttttctttccgccattgaaacgtagtttcattatttctttattcaattgatcacttttcatctttttaatctgaggagccgtattcactttttcatcaaaagaaggcttctgattgcttacttcctccttggcaggtttcgttctttcctgaattttaaatccgatcagttcttctatgtcatgcaaatatctggtttgtgctgttaccacgaaggatatggccttccctttttgccctgcacgtcctgtcctccctgtacgatggacatagttttcctcatccagaggaatgtcatagtttataaccagagaaatattctctatatcgatccctcttgctgccaaatctgtggctgctaaatagcggtactctccccttttaaaacgtttcattgcagataaccgatcatcctgttccattccgccatggattttattacagggatatcctaaatcctgcaaacggctgcataccatatccacccggtcctttgtgctgcaaaagatgatgcagctatccggattttccataatcgtaacatcagtaagtagtttaaatttatcttcttcatcggttatataaagaaaatgatcaatatcggctgtcgtgataccagactcgctgacatctatattgacagggtttctcatataatttgatgatatgcgttttacttcatcggacatggtagcggaaaacaacattgtcatccgttccccgggcagttcattcataattgcttctacctgttcaataaaccccatatccagcattcggtcagcttcatcaattactaagcatttgatcatacttaaaggtaatgttcctttttttatgtgatccatgacacgccccggtgtaccaatggctacatgtgttttctgtttcagctctgctttctccatagaaaatgggtgtcttccatagattgccgctgcttttattcgtttaaatctgcctatattggtaaaatcctcttttacctgaacagccagttcccttgttggcgtcaaaataagcgcctgcggcttattttcaagccattcaattaattcacatattggaattgcgtatgcggcagtctttccgcttcccgtctgtgctttgacaatcagatcatttttttctaaagcagtcggaataactctggcctgaacttctgtaggtatatcatactccaggccacgaagtgcctttacaatatcctcactgattatatcattacgaaaacttctaatatccatatctaagcctctcctttaattcaaaaactggatcatatcaaaaaggatcgctcaatttttgataagttacatgctaacccattttacatgaggatgccgttcaatgcaataaaaaccattctcttcctttctctgcaggcttgatttttcatacagattcttttattatgggtttgctattatgacttgcatttgatatcatataatctataggaatattcaaagccgtcagtttctcaggcgctttgaatcatacattaaaaacagatatttaaagaggtgaaagcaagaatggataatcaagaacaaaaacatcagcgccgccccaggtataagggtactcacccaaaagcctttaaagataaatacaaggaactgcagccggagttatatgctgatgctgtggcaaaggtcattcaaaaaggaaatactcctgccggtatgcatcgttctatttgcgtgaaagaaatattagagttcttacaaatcactcccggacaaactggattggatgcaaccttaggctatggcggacatacgttagagatgcttaaatgtcttaattcaaaggggcacttgtatgctactgatgtggattctatcgaattaccgagaacaagggagcgtttggagcgcttaggttatggtccggaaattttaacaatcaagcaaacaaacttttccaatattgatcaaataacgtcccaatcgggaccattgaattttatactagcagatttgggtgtctcttccatgcaaatagacaatcctgaaagaggattttcttttaagacagaggggccattagacttacggctcaatccatcaaaaggcatctctgcagcggatcgtcttaaaactatttcccacgaggaattatacggtatgctcctggaaaatgcggacgagcctcattccgaagaaatcgcccttgccattatttctgcaataaaaaaaggaacagacattacaacaacaaatcagctccagcaaattattaaagatgctttgaaattcattccggaaaaagacagaaataatgaaatcaaaaaatcctgtcaaagatgctttcaggcgttgcggattgatgtgaataatgaatttgaagtgttatatgaatttttagaaaaacttcctgctgccctggctgaaggagggcgggttgctatccttacgtttcattccggcgaggaccgtctcgttaaaaagtcctttcaacgcttctatcgagaagggatctatagagaaatagctccagaagcgatccggccatcagcagctgaatgcaattccaatggccgtgcccggtgtgcaaaattacgttgggctataaaatcttaatagaaaagggtaagccagtacagaaaatgattactgttttcggttgggcttacccctttcttcaattacaggaacaatatgagaataaattaatcaataacactgtttatatcagaataaaaatctataaaagtaaagaacgatctactgtttaaggtggtttagattttcaacagtctcatcaccatttctcatatcttacaatttcatccatcgcttttctcggtcgctgttttggtgtctcatctccatatcccagcgtaatgattccgcacacatacttatcatccggaatattcagaataggcctgacagcatcttgctcaaaccaggctgtccaacaggtcgccagacccagatgttccgcttcaagcaatatatgttccattgcaattgctgtgtctcgaataatttgcttaagctcttgttcagggcttctctcatccagtctgactttggtctccatggaaatacggcagcgaatatccgctacgcacacaataaatatgggggctgtcatcatccatttttgatgatgatcggcaattgaaagcttttctttcgtttcctccgattcaatgataaggaacgtccagggctgcgtattgcttccagaaggcgctaatctggcactttccaatagtttaacaagcttttctttttcaactttcttatccagatatttacggacgcttcttctgttttcgatttgttttagcatggcaatctcctttgctaataactcacatttttaatgttcaatggactgtaatacatcatggctgtcttaacaaaaaaagcaaatatcagagtgtcttgagtcaagatttaccgctttttgtcctttactgaaaatttattataacttcttttttctttcaatgttccatctgctgtcatccgatatttcttctttgatgatgaagcgctgtccatggaagctgtgtacaatgactctctctttgacgatgcacccgatttcagtgaagcagtcttaggtgatctttttgatcttatgattgcatccttcgggggtttgacttgagatttcggtgcttttgctgtatcccttcttggctgcacaatctttttcgttggaacgttgttcattaacgggtagggatgatcttttatttctgttaatttcttcccaatcaacttttcaatatcgttaagctgtcccttttcgtcaaaatcacagaaggatattgctgttccgcccagtcctgccctgcctgtccggccaatacgatgtacatacgtctccggtgtatccggcagatcaaaattaataacatgggtcagttcatctatgtctattcctcttgccgcaatatctgttgcaagcaaaatccgcaatgttttgtctttaaaattgcttaatgctctctggcgtgctccttgtgacttatcaccatggattgcctgggcgactacgttattccttgataattgcttcataagccggtcagccccgtgcttggttcgagtgaataccagtgctgaagctatgtttttatctttcagaatgtgcagaagcagatccttcttattacttttatcaacaaagtacagatactgctcaatggtatccactgttgatgataccggagtgattgctattttcgcaggagtctttaaaatcgtacccgccagtttggctatatctggcggcatcgtagccgagaaaagtaatgtttgctttttcgaaggtgttttagcaataatccttctgacatcgtgaataaatcccatatccagcatacggtcagcttcatccaatataaatattttaatatgttcaatatttacaatcttttgatcaattaagtccagcagtcttcctggtgttgccacaagtatatctaccttttgctttaaattttcttcctgcggcttttgagatactcccccaaagactacacagcaatttaaattggtgaattttccataagtattaaaactttcataaatttgcaaagccagctctctggtgggtgttacgatcagggcccttatattttgtctttcctgatgagacactttttcttcgctgagcagctgaatggttggtatggcaaatgcagctgtttttccggtaccagtctgggcacaaccaagtaaatccctgccgcttaatataacaggtatagcctcttcctgtattggtgtaggaatatcgtaactttctttttctaatgccattataatttcaggcataatatctaaatctttaaattgcataaactctccttttgatctgtattgtttttatttatttcttatctgatgcttgaccaagccagtctgtttccagccacattacatcacattcagtataccctaagcacataaaaatgatgccgtttaaaaccggttcggcatttactgcaatggaatttattcaatgctcagtatgatttactttcatatatatgaaatgctgaagaagtagtttaacttctaaaatggctcttacaagatgaattaccgcaaatacccgctatagttccagataaggctgtatatagattgtccatatttcttttacagccccttctgtaaacatggctttctgtaccatggacatagaaagccatgagtataatgattattatcttttccaccaaaacaagttccttagaacaattttaacattctgatatggctgccgtttttatagaattcataagttactgttcttgtatctatgtcttctatttcggcctggaaactactattctcttttactaattgcatacaaagttcaataagaaatttactaatgttccctaagcttattctctattgaaacgttaatatctgatataaccggattattcatatcggctattttacataaaaattcatctatattaagaatgatgttttgtgtttttttcttcccaataagtaatatattgtattcttccaatagcactataaatcttcgtttctacaactgctggaaaaatcctgtcttgatagtccttttccttcattatttccaatacctcatacatgcaatgaaaggactttaagtaattatcagttataatcagtatagcataatccatatctctgatgctttgcatgtattcacgaatgcttttccattgactaatatctctaatatcttgatgtatacaaatatcttcatccttaaaatataaattaatattatcggcaaagattttatccttttgacaataggaaacaaatatatttatcattattctcccccacttttatgatcatttgtttcatatactgtaaatcaaatgataaatgaatcagctttggcgaaaaagcgaccacattttttctacatatgattttttattttcctcaaattttgtttttgcttcatttatgctctttatatactccattctattgtttttaatcttttctcccagtctgttcatttcgtcaataccaaatgtggggatttcaaaattttggagttgggagttattaagtatttttactgtggtgcccgtatggatcccattaatcatcttcataccaatttcactttgaaaaaattcaaaaagaacatagggattgtatcttttttgatctacacgtataatcgtaagattggagctaattaaagaaggcttaaattcattctccacaattgcaaatttcagactccagccttttgatgttaccaggatgtcatttggcttaatatcatatcttcccacccattcccttttgacatgctgaaatgttacggctgaatcataatttactctcccattttctatttcttttatattaaggcataaatatccctcagaattgtccttgcaaacatcctcatttttgacgttaagccctcttttaacctctgctatatctttcaataagactgtatctaaaaacgattttttaacggcatcaaaatcaagatattcaatcggatttattctatatccaaagtccttaatcttaccaatgtcaacaaacatactgaaatgttttttttcaatgccttctttataagctttcgctatttcatcaatgctctccattggaatggcatactgcattctattgattttaattgaattttggctggcatttatgaaaagtattttgtctcttctttcatgcgacttatttttgtttaagataataatttctgaacccagattggatttttcatacaagctatttggcagagtaattatgcattcaattaaatcatcattaattatattctttctaatctctgattcgcttcctctaaccaatgcccctttggtcccgattaatattccaattccattagagttcatattatatatgacattttgcccaaaggcccattccgcactatttttgactggttttccatatttcagccgaaaatcatgattaaaagaattttcttctgaatatgaactttgaggcatatctgatataactaaatcatattccgaaccatttttcagattttcttccggcaataatacatctctattcacaatattagagttcctaagttcaaaaattatcattaacagctttgaaaccagagttgaagaaagaacgatctcttctccatggtaataaggtaattgcttacttgaagtcttccttatattttcagaaaaggtaatagcaattttagaacatccacagcagtaaacggccatatcccttactttgtctatatcaacgagtctatatataagctcaataacagaatcgggagtatcattgcttctattaaactcagcttctgaagacaaaatcagctgaaatacggatttcaccatatgcttatctaaatgcatttcagatatcagttcatatatatttctgagtattttatttatattaatatcaggatagttaatggcattatttattagttctgtaagtgcattttgaaattccccatgctctttctcaaattttataagtgcctttgttaaattatctacaaatcctttttcatcgcatctctcaatcaggaatgtactatcacaataatttttattatctttaatccatgctatagtgagcattacagcaatgatttcaaatgattggtcatatgagaaatagggatcaagttctttatagcataaattaattcgtgaataaaaatcactgagattacgaatcacattacacctcccaaaagtatgtacatactttataccatcatgtttgtcatcagtcaatagttttttgtaaaaaattgaaaatttccatttcccgtatggtttcccgccagtttccggttaggatagaaaacaccaccttttcagtattgagcagcgcaaattttatcgccctgttgcaaaccattgctgtcagttcctgattttgtacagatcggtatgctctatagattgtcagtttatagtaatcctatttgggaccaccttttttttacaccagcatagctgtctcccttatgcagaacaaaaggcttcaggccgattccaaaaatcaatttccgttttattcgttgaaatctatagtccttctgttgttcaatatcgttatatagcctttggacacatcgtttcaccttggaattgagttttgaatttgaagagcaatcactattaaaagggattttttccacaattgaaccgcacattactgcgccagaaagccttaaaagtttgtttaatacccctgaggcttcttttccgccataattctcataagttgttacgcttaatgcgtatttcctgtgcagaagctgttctatgacaaaatgccctctatctataaatacctttagcacaccaggaacattgcttgcgattgtcgaagatccaatgattactccatcggcattacagagttcctgtgatattttttcagcatcatcgtttataatacagtgtccagtcttataacagctgcaacatcctttgcacaaagtaatcgactgctcgcttaagtcaaagaaaataacacttgcacctttctgcagcagattcttttcaattacatgtagaatataagcagttgaaccgcactttcttggacttccatttataataacaattttcatcaccaaagcatctcctatttcaaatattaataatcggcaatactttttcgcctgattatccaatataattatagctgtctatgaaatcgcgcggagtttccttgttgtgaatgaggtgatctttgctacgaatttatgttatcaagcggaattttgccggaaggaaactgtcaggattggctggaggctgtaggtatggagatgccggccactatagaggaacttcacgacgttctctatgcattcacctacaatgatcctgatcagaacggcaaaaacgacacctacggcttttccttaaaatacagtgcccttccccgcttttccacccagttaagcatctatatgggctgaccgaatacatgggggattaatgaagcaggaaatgttgcacctgaattctattatgatacctacacgaaatcccttacatggtttaggcaggcttattccgaaggtttattcaatcaggatttccccatctgcaaggatgaaatgcagaacgttacatcaggtgccgccggcatgttgtttctggggaacttagaggatgctgcaacccgcgttaccgacctgactgccgtttacccaaatgctacgaccgatatcttccagctgttaaaagcagagcctgacgcaccctatcatattaccggctaccagggatataccggcggcgatctggaaaatcagatcaatgatgccaaaatcaaatatgtaattggagagctggatttagatggttgaaaggccgccattgaggactggaaagctgcaggcggtgagcagattatcaaagaatattcagagcagtataaagcaggtaaataatatggcatttctccattgtgaactgaaagccgaatcaattcgcatggtcacttccgtctgtgtggtcctaccgcaggatttctaccggacagactgtccggttaagacgctgtatctgcttcatgggcgttcacataactattctgtctggacccgctataccagcctggagcaatatgcacaggcccataatgacgccattatcatgccggatataaaccggagcttatacagcaacatgaaatacggactggactaccagacctatgtatcggaagaattaccggatctatgcgaatccatgattcattagtctatcgtctatattggtccagcaaaagccgtatccgggaaaatacgggcaaaagctatatttctcttacttattatttgcccgtaatgctatcattctttttacgtcattaagtatatctatacttttcacatcaagcatcaaccattttccgctatacccggaaatagtttgtttaaataagatttgggtgtattcagtgcataatggcattaacagttctgcttcattcatttcacgcattcctatcaccaccaacgcaataaaataacctttcattggataaagtatgcatagcggcttcccgcctttttgatatttgatattccaaccgctttgcatggaacaaccgctataagcttttttaggtggtgtcctatacgtatcttcaaggtaagtggttatgttataccataaatcgttgtttataaattcttggatattttcatctgttggtgggtgggagttatcatataattcgttccattgcatgtcatcacctgatttctgattcggctatgggaacaggtattacccatatctccattttgcggacttccgggtttgtcgcataatacttttccactgaaaaaggctgcgccgttaaaccgtgctttgggagccaaatgtcaaataagtaattcatgcttttatagagcgcggatgatgtcagttccgcgaaattctccgcttcaaatgaacagatcacatattctgcggcaggcagttcccacacttcaaaatcgccggacgcttttgcttcaggcattgcggacgctccgacaaaataggtgaagtatttttcaatcttaccgcttaacgataccgccagttctataccgttcggcacgagaccttgtatatcagccttttgatcgtggaatttatcccacagcagaccgggaacatcaacgcccgttgtctcgctgagaggagtttgttgagataacggcacctgtccggaaaaaccaatgtaaagctctggaacatttagcactttacgtgatatatccaaaacgatactgtcagtaataagcggtacattttcgtcaatcatagtgtaaccaagtaacaaatcgggctttacaatctgatttaaccggacaggatgattgcggtactcctccggggttatcccgaaagcgcttttaaaggtttttgtgaagctttcgtggctattgaatccgtactcaagggcaatatccagtatacgcctgtccttatcgctaagcgtttcacatgcccttgccagtctgcgcatttttacatattcgtataccggacgcttaacaagtcgggaaaaaaggcgctgaaaataaaaaggcgatagtgcagcgacttttgataattcttcaggcgtattgttttgcgctaagttgtcctcgataaagtccaatacattttgaattgattcccatgcgtgcataataaaccctccatattttttatgccacaattatatcaaagcaaaaattattcccgcttgtctgtcaatgctcttttttctagaactgataccgtaattgtttcgacatattgctttgttatgaatcgggaaacaaaagcgaaccactgaagtatgccctttaaaatatagatattaggcatttctattcaatttgccgggttttgaattgtgctcataatgcgaaatttgttatcaacaagaattgaaactctgtatttgataattcagttttttacttttcgccagccttgaagttcaagaatattgccttctggatccctcgcataaacaaatactgcttctacattattcggatatccagcttcaaaagctaaatgtgcaatacctggacggttaatttctgcgggaaggcattcttttagctcatcgtaagaaaaaatcccaagagtaggatgctcttgtccataaccaggcaaaagcaaatgctcaccaataatatgcgctccgctcaaacaggtcagtatatctagccacgcccgcttagattacgtgtctcgttaatgctcttgcaatgaagcactgtcttataaaaatctatcagtttacccgcattcttagcaatgatattagaatgaacgtatctaaacatattcaacagttccttttcacttctgcgtattatataaatgataagcaataaaggcggcactatcaattcctgtttctatctgtcgctttcgaattatcggcaaaaaacgcaataacctaatctctattgggccttaaaggtttttcccgctcttttactaatttattttcagaggtgactactacctttgcatagtttattttaattccagtaaatctaatgacatattccttatccttttcaagggtatcaagagaaatagcgaaattagttttatcgacatttccgttccattctttgctccaaaaaacttgtccagtttcattgtccgcaatctctaaactactgcgtttaccttttatctgaatagaaatatctaaatctaatatattgatatcatcggatacatatattaacttttcatatataaaagggtcagatgtatcataattttctgttaattctatttcaataattgttttcgcagttgatctattacatgaagcagacacagcactgattaaaaataatataagacaagttgtaattttattgtttttcattgtaaaacacctttcacaattgtacccttgattctgtataaactcattaaatggaatgggctagctcacctttttccttaataaattccagaaattttagtttttccatttcttctgaaaaagcggttaccggaagaatatatgcctgtacagagctaaaataaatataaatagctttttctgttatagcaactttttcaatcaacgaatactttattacattttctgtatttggtgtgatttcatgtattttctcattatcgaactttaagattgcctcgttgctgtaagggagcctaccttcctttttcatttgtatcactctgttattcatggattttagaattatctttttgctatacccaatccacaaaatagaaaaaaccgtcatcataatagcttcaatcaaaatcagttcaaaatcagagcctgcaatacaaaatataacaaggaccataaaacaaaggaatggaataattaatctaaaggacatcaaagattttttaccagaaggactatttaataaatgatattgattaaatagtaaataatcattatcatctaaaaatatattaaactcaaacataattttcgcctcttattctacaaatactgtattatttcagcatatacattcagggcactcttaatcagatgtggcttacgctgtataatgctctaaagtccaatttaccacgcattaatcataataatattaaagtatcactataaatcatttaatcaatccgttgtgaggcattgtacttaattcataaatttttgttctcaatttattttctttttaagaggttcaagagttattgctcgtattattaacaacgttccattttgtaacaagttacaggaataaggctgatatctctggccgtgacttcatggcctgctgatcaacttactttgcttcatttcttgcttttaggtattgtgcactgaaaatataagtataaatacgggttctttgaaatctcctttcctctgatctgttcttcatgtatttgtccatgtttatcaccacatagttttatagtgtatccagctaaagtcatttaatgccggactttcttcaccgcacttcattaatagctattttgcaaactaaattacacacgaaatgaaagagtttggggaagttacctggcttataatgatagcaagacaggtgataaaatgattgatgagaaatacacctttgaatgggtgaactcagaagaacaaaataaacaaccagcaaaccaaacgctgcgaaaagtaacatttgacttgctggttgtttggtatcgcttcagtattctcaactccctctgggtgctatattttcatattgtaagccagctggcggagccattcatatcatacctctgccgcacttctgcagcaattttttccctgggattttgccagataaagggcctggtcacaaagcttataaagcacatcaatatctgttccttcgtcagggagaatgctgaaaaagcctatgcttattgtatactttatcgtaggatcagcttctacggacgaattctctaccgtgaatctcagccgttctgcaacttcttccacatttttctcatctgtcccgggaagtaatattgcaaattcctcgcctccatacctgccgaataaatcgcagtttctcaattgttttttaagagtactggcaaaatcctgtaatacaatatcacccacaaaatgcccgtacttgtcattgatctttttaaagtcatcaatatcaatcaataaaaatgagattttttcttgcttcttaaaacacagggaaataagctcttttgaacgcaatataaaggtctttcggttcaaaatatctgtcaatccgtcaaaagatgcagctcttaaaagctctaaatcctgcttttccttatctaagaggatgaacccggtgcttcctgcaagcatcacaacgtagagcagcaaaaacaaccaggtattaaaaatgtttgttgatgccagattcatatccagatctgtggtcaatgctgcaacagcccggaatatcaaaaacaatatggtaaggctgtataagatggcaattactatttgcagcctggaagctttcttatcggtaaaaagcttatacacggggaataccattaatattgctgtaatggaggatgcaaatgtaatcctgacgttctcaggaaatccgtatcctgtcgcagcaagaaatacgatgatgcagccaataagtaaggcggtataagaacgttttaccgtttcagtataattgcttttcagcatcataagagcaatcagttccaaagccgcaccggtaaacaaggtcgagttgcccacagcgactaaaatcatactgggtattatgcctctcagaccaagcataacccatgcggcaggctgcagcaattttgaaagcaaaaacatattgaccgccttgcttctcttctgctgctgggtataagcaataatgagcgcacctgttaaaagatggcctaatacaagaacaattaaaattgttgccatgttaatattgaaaagaatcatctgtatcccccacagttccaaactgacttttttaattaatattttgttttattcttcatcatgattattgcttcaatacaatccgttgcaggaaacatatctacccccatcccattttcgcctcataccccttcttttgaaaatactccaaatcccttgcaagcgtttcaggcccgcaggacacataaataactgtttcaggcctcattttcgctacagaatcaataaactcttccgtgcttccgctccttggcggatccataaacaccacatccacatgttctccgctctccgccatgttcaccataaacttgcctgcatcattgcagaagaatctggcattcttaatctcattgagcttggcattttccaacgcatcccgcactgcttcccgattcagttcaacgccaataacttcctttgcatgcttactggcaacaattcctatggtaccaatcccgcaataggcgtcgatcaccctttctttacctgtaagccctgcagcctcaatggctttgttatagagaacctccgtttgtaccggatttacctggtaaaaggatttggaagaaatacggaaacggcagccgcagagaatgtcctcaatatatcctttcccatacagcacatgctccttattccccagcaccatgcttgtatcccggccgtttacattctgtatgatcgtagtgatctccgggtgtttctcccgcagggcttttacaaaattgtttttagaaggaaaaaccggtgaggcagttatcagaaccaccataatttcctccgtagtaaatcccctccgtacgagtacatggcgcagtaacccatacccggtatcctcatcgtaggtacgtattttaaaggacttcaacatgccccttatggttccgataatctcatccgctttttgatcctcgatcatacagcgttccaccggaacaaccctgtgggagctcgcttcatatatgcctgaaacaggattcccttttttgtcatggtcaaacactgcatgaaccttattgcggtaatgatagggattctccattccaatgatcggtgcaacacggcaatatggtttcagcaatttctccagatatttttgcttttgctccagctgtttttcataaggcatgtccaaaagctgacagcctccacacttactggatacaggacattgggaagaaaatcttcttactcttctgttttccttttgaaacatcataccgtccccgccgcttttactgctgtcactgccatttttgccgcttccactatggtggcttccaatcctttcatcgtagccgccgctcctgccaatggggctgccgctcttactgcggttgcttccgaccctgtcatcgtttttgccgttccagtcattgctgtttctgttattaccactgtctttgcctgtcttgccaccgtcgcttcgggttttacctctattcttgctgttcctatcattatagctgccggtcctgccatcgctatttccggtcttgcctctggtactgctgttcctgtcattatagctgccggtcctgccatcgctatttccggtcttgcctctggtactgctgttcctgtcattatagctgccggtcctgccatcgctatttccggtcttgcctctggtactgctgttcctgtcattatagctgccggtcctgctgtcttcctttcccttctctccgccgatcttcctcttatcactgccctttaccattctgtcattcctgaatttctcttttttcagcctgttatctatcataaatacaatccatccttcctaaatctgatctctttcagcttttgatcttttcctatatttattcatttcctatccttattaccttccaattcaacctttccacataataaaacccggccttttataaaaccattttaattactgttttttcgccgggctttttatctgtttttttctccacagctattataatacatctccttctccaaaaccactgaaattcttacgcacatacaaaaaatacttgtaattttttctacctcggatataataaatcataaaaagacaaaaggaagtgcaacacatggttgatacatacgataactttttcctggataaaaccctttataacggacggccaggcaatttaacaggacgtcttcccaaagaaatccgcacctatgaccttctggacaaactgaacatatcctatcagcgtgtagatcactctccccttcccaccatagaggcctgccgggaggttgatgcgctgttacaaatagacatctgtaagaatctgtttctgcgaaatgcccagaaaactgatttctatcttctcctgctgcctgggggaaagaaattccgcaccgccgctctttccaggcagatcggctccgcaaggctctcctttgcagagccggaatttatgtcccaatttctggacatcacccctggctcggtttcggtcctgggccttatgaatgataaaggccgccgcgtcagactgctgatcgataaggatgtgctttccagcgaattctttggctgccatccctgtatcaatacctccagcctgaagtttaaaaccgtggatcttttggacaagatccttccggctattccttgtgaatacacattagtagacttaccttccggacaggattgatccctgtttgtgcagccgggtctattatattataataataaaagtataaaaggggctgttgcactaagcaacagcccctttcatggtttttgacagtcaggctatccaaacgtccgaaaacgccttagaccctttgactttggttccccaccttttggtgggtttgcccttggctctattctgttgttttggttatcctcttgtttttagtacggcgatacttgtgttggatcataagaaatccaacacatttttttgcatttttcaccatatttttgctttccgttaaatcggtaaatggagcaaagcgtatccgcgcttatgacgcgctcaatagcatcggcatttaataccgctatttattttgaaacagacagggtctccacaagaaaatcttcaatgtttgcaatcttctccaccatagaaacagagtaacagcaatatcacataaacgcacagtgtcaccgatactgaaggaaactgaataaacagctttcaaataattcctaatagaatctgtcaattgcttcataggagtccccccttatgctggtttggcggtctactgcatagcctgatttgtctgccacaggctgacctcctggctgatatcccacaagtttttataaagaccatcttccagccggagtacatcgtgctttcctgactctgcaagctgtccatgattaagaaccagaatttgatccgcagttctaacagcagacaagttatgagcgataatgacaagtgtcttatttttaattaaatggttgatcgcccgttgtatcagcgcttcgttttcagggtctatgctggaggtcgcttcatccaacaggataatcggagcgtccttcagaatggctctcgcaatagatattctctgcttctgtccgccagaaagagtatttccaccttctccgatcatcgtgtcaaagccatgctccatctccataataaaatcatagcaacaagccttcttagccgcttcaatgagttcctccatagacgcgtcctgcttgccaaaacggatattgttagctatcgtatcctgaaacagatacaccttctgaaataccatactgacataggagaggacttgatccagggacatatcccgtatgtcgataccgccaatttgaacctttccctgggagacatcataaaaacgtgggattagctttgtaatggtgctttttccgctgccggacgaaccaaccagcgccgcagacgtatactccggcacatgaaacgacagatccttaagaaccggttcctttccatatccgaaggttacatgatcaaatgtgatatcaaagcgctccggaatggtgccagctgtcttttcaacgttcccttttaatccggcgttggtgatttcttcaattcgatccaaagaggcctccataatacgcagcatgggcgtttgggaagcacactgctcaagtcctgcaaacatcgttaaggatgcaaccaagagcattagataagcagataattcaagactgccagacagcgcggccaaagatgaaacaaggactgtaacacagcctgccagctttacaaccatctgaaaaattgacacccactgtacaaacccgcgttctacctgaaaggaacggatattgctgttatgaaacgcatcagaaatacgctttgcctgtcggcctttcattccatatgctttcgccgtaataattccctgagcaaattcaatggccgctgagccaagctccgcctgggtgttctgccgaagagggcccagttctttcccttttttctgaagcaaagcaaagatgagcacggacggcaataacgctatgatggcggcaagaccgattctccaatcaaaggcaagcaggaacacagcggttacagccgtcatcaaaaatccgtttaccaccttatccagaataaacatcacatacatctcaataaaactgagatcggtggtcatgcaggcggttaaatcgccttgcttatgcgcatcaaaaaacgacatgggtgcctgccttaataggcttccgattttcaagcggctttccgccaccatttcaaatcctgcagaggattgaaacctggataataaataacggaacagtatccgccctatgagtcccatcaaaagcaagcctatcgcgatggcagcctcccagccggtaatgacaccgttttgataagtattgatgatataaaaaattgctattaatggaaatacattaaaaataccctcgataaatccaaagacgaacccatagataattctgggtctcaggctgccggacattctcagtatgcggcgcagcagcttaatcatgttcacacctcccaatgctccatttctccgcactgacgcaggcgttccatagccttgcgtaatacgggcagcgcccaagcagcgcgtcatggtttcctgtatcaatcagctttccatgatccatcaccagaatttgtttggctcccgcaactgtttttagccgatgggcaaccataatgaccgttttctcctgtaccagcttctgcagggccatctgcacctttcgttcgttctccatgtccatgctggcggtaggctcatcaagcagtagaatcggggcatttttcagtatggcacgggcgatgcagacacgttggcgctcgcctccggagagcaaatcaccgccactgcccacaacggtatccaacccctctttcagccgatgaatgatttcctcacacccggaagctctcaccgcttccgaaatctcctccttcgtggcgccgggctttccaagcagaatattgtcgcaaatactcatgtcaaacaaaaaattatcctgatcgacaatgctgatgatattcattagctgttcctgtgggatttcccgaacgtccctgccgccgatacatattctgccgctgtcaatttcccaaaaccttgcaatcagccgcaaaagcgtgctttttccagctccggattctccgacaattgccgtaacgccggaggaggggaactctgcgctcacactgtccaacgcaagcgactggttgtaggaaaaccggacattttctaaggtaatccggaaattgttgatggttactggaacggaagcgtactgaggctcttcctgttcaagaaaatcatgtacttcgcgttctgttttgacaatgacagcaaagttatcaataaattcagtcagcttaatcagcggcggaattaaggcaaaggagagcaaaaagaataagagcaaggtagccagagaaatctcgccctgcccgagcaagaccatgcctaccggcaaaacgcctgcaatggcagaaggaagaatcacatagtatgccgagttatagggccagttgtgccgataccatgccaatgtaaactccttataataattcacagcctgatggagcttttcaaaacttctgtctgcctgattaaaaatctttattacatcaattccatcaatatattccactacggtctggttaagggcctctcctgccttcataaattgcgcataccgttgcccatatccccgaaacatggctttcataattattagtcctataggtacagtaatcagtgcgctgaaagccaagcggacattcataaacaacatgagagagaacgttatcagaaaggccgacagatttcctgttacctctgggattgcatgagcaagaggatattccagcttctcaacctcatccagcacaagatttttgtattcgcccgatgagtacttccgaattgtccccatggagagccgactcattttgtcagttacactttgacgaatattttcaagaatctcaaaagtgtaccgatgggatagcagcgtactcccgccatgcagtataccttggaggatatatgccaatgcagacaagaccacccaaagcagcaagccttgataggtcagattaccggcaagatagttaccggcaatctggcctattataagataggggacgagaccacttacaactccaagaatagacaacagagcagaaagcagcataggtcccttttttccccgcgcaaaagtcatgattccccgcacagtggaatgttttgcagcagttttaatattcaacttctctcacctctctttcattatttactcttagcctgattgatacaatcctttaccgctgccttgattgcgtcacaggatactgttgctgaggtaatcccatctacttcccaagtttgtgtctccaccattttggatggcaattcttcaattgctctgtcaccaatgccaaccgtttcattttgatcagttactgttacagatacaatggaatccttatcaaactccacttccaccgaaacatcgcccccatatccttcggcagacgcagtataagtcccggcttcatatattcccgaagaaccgctgcatccggccaaagaaaccatcatgcataagactatcattaatgcataaatcatctttttcactgttcatttcctccatttgcttatcactgatcctgtttttgaaagacttgcccacgcacaccataaggcaggcatacgggcacatccagaacgggatggcgaacaactgccgcctccacgttgaaaacctcccgaagcgattgaggtgtgattacattccccggtgaaccagagcagtgcttttttccatccttgactgccaccagataatcggaaaacatgatggcgtgatttaagtcatgtaagaccataaccacagtaacattctgttccgaattcagcctttgcaaaagctgtaaaatttccagctgatgcgaaatatccagatatgttgttggttcatctaaaaacagaatatctgttttctgtgccagtgccatggctatccagcctcgctgccgctgcccgcccgaaagctgatccatttcccggtcagcaagcgctgacatacctgtactggataaggcccatttgataatttccctatccttttgcgtaagtcccgataattgacttttgtaggggaatcgcccgtattccaccaaatcgcttactgtaatacccgtgggtgtctgcgcaccttggggaaggagcgccagtctttgcgccaccaatttggtgggcatgctgtgaatggactgcccatccagataaaccgcaccggccgacggtgcgatcagacgggacatggtttttaaaatggttgattttccggagccgttggaaccgattagtgtcgttattttccctgcggggatttctatatccatatcacggaacactgtgacaccgttataaccggcggacagtttgtcagctgtaatacaggatttcatgatttgttcacctccttatacctgcctgcgaagcagaattagaaaatagggcgcggccagaacagaaatcacgattccgaccggtatttcaatggttccaaaaagtgagcgccctatggtatccgcaagaagcaggagcaatcctccaaacagcatggatacaggcagaagtacatggtgccgcccgcctacaaatcttcttgctatatggggtgcaaccagtccgataaagccaataccgccgctgacagaaatgcaactggccgccagcgacactgccacagccagcaagacttttcgttctctttccacccggacgcccagcgcaagggatacttcttctcccaaaagcagtaagtccaaaacacctgcttttgtgaaaagcaagggaagcagaatcagtagataaggaagcagcgctttcacctgataccagctggttccccagatattacctgccagccacctggccaccaactgataactgctgttttccatgtcggcagccataatcagcattacggacgaaaaaccagctgaaagaccaataccgccaagcaagagataagccggcctgacttttccgtttctttttgaaaaaacgtatagcaatcccgccaccagcagccctcccgccatggcgaaaagcggctgatagatcatggtgctggtgtgcaaagcagggaaaagcgtcaaaaacagcatgaccgtaaagcccgctcctgcgttgattcccaatacacccggatcagccagcgggttttctgtcaccgcctgcagtatgcagccggatagggccagccccattccgcacagaacggcaaggactatgcgtgggaggcgaatctgcaaaagaataacggatgcatttggagcgcttggatgtaataggctttctgccacatcagaataaggaatgctcgaatagccactgttgatggacagcagaacagccgcaattaccgccaccaggaggacccatggtacaaacttctgcctgcatttctttttcatagaatcgctcctttcttctggtatgtcagtgccagaaaaactgggacaccaatggctgataccagagcacctaccggcgtatcaaaaggagcgttaatggtacgggctgcaatatcggcaagcacaagcagaatcgcccccagaagcgcagagattggtaaaagccttccataatcctcaccggcgaggaatcgtgcaatgtgaggcacaatcagccccagaaatgatattccgcccactaaggatacgctcgccccggccagaataagcaccaccacaatgccggtgagccgaactgcccatatgtttacaccaagccccgccgcgctttcctctcccagagccaatactgataatctccctgaaaggagcagactgacaaaacctgcgcccaaaatccatggaatggtcaggagaaggttctgccatgtaatgccggacaagcttccagctgtccaaaaagacagcgatttggaaagcccgaaggtaagagaaaccccctggctcaatgcagtcagtaaggcagaaacggcagaacctgccaatataagccggatagatccggttttgtgcctgccgattcccaacccatagaccatcagcacggccagggccgctcccataaaggccgaaagcatcgtaccgaggcttgataaggacggcaaaagaactgcggtcagagcaacgaggaatcctgcccccgcattgattcccaaaagcccggcatccgctaaaggatttcttgtcacaccctgcatcacgccgccggcaagggcaaaggccgccccggtaaagcaggcggccaatgctctgggcatacgcatttcaagcataatccttcccatgtcggttgatcttaccggatgcaaaagcgcatctatcaaaacattcagatttccgcctgccacacctacactggctgagagcaggagggaaaacagtaagatacacaccatcagaataagggaaagcgcaaaccccgcttttgtccgaatccattgtaaggggatagggggagggcttgccggggcctgaggcttactcgacattgttgtggttgataatggcgtttgccagtttctccatgtacagtagcttgccgttcgccgtgtacgccatattatactgcgcctcattcttaccgtaatatacgtttccgttttttactgccttcaagttctgccaaacagggctgtttccggtatctccaacccgtccgtcatcgctaaaaaagaagatgtgatctgcatcgattttcgaaaaatactccgcgtcaacgacctctccccacacgccttccggaactccggacgagggagccagcttcagttcatcgtatatcaactcacccgggcctccggtccggtaaacgtaataggaaccgaaatgtaccgaattagcttccagaacggcaaaggtgccatcgccaaccacttccttgacctttgctgagagctcggctgcctttgcgtcatagtcagaaagccactgcgttacaatatcctctttgccgaaccactggccaagctgctgaaaacgtcccctccagttgacatagctgatgtcgtcgttgatcatgaccgtaggggagatagctttgagctgctcatataccttatcatgccggatattcatgataataagatctggctttagctcggcaattttttcaaggttcaaatcgcccgatgcggaagctccggagtagttgcccactgtctcaatattgtttttagtgaaatattcctgaagataatccggcactgttataccgtcaaacatactggtgttggccgaggcgataaatggcatgtccaaaataatcagttcatcagccaagcccgaaacatctacaatacgctgcggattggcaggaatctcaaccgtgcccttcatatcttcaaccgtaatggtaccgccattttgaccttccggttttgtatccagaacggaagatgttggctgccctgatgtttgcgggttatttgctgcgggcgagcatgcggccagtgccaaagacagcatgaggaaaattggaattataagtcgcttcatcactttaaacctcctaatattaattgtactttgattagttagagaaagctaaccttggtcagtatacgaaaaagcaggctttctttctgccctgaaacggaggttccctgccccttaacggaattacatgattcagcggctttttgtattgctgatcagcattagatgtttattgtagatagtccctattgactggttaggtaaaactaactataatagtaatggattcataggtcgttttctgccttccggcggattttctttgtcccaagatggacattataaaggttgataaaatgtcatatttaccgttaaaatttgaagcatcaaatatatttccaaaagaaacaattgcgatacggccggatgtacatatcgtggtgtcctctggtacattttccaacatagtaaagagaaaatccggcaccacatctcctgtgtttgagctaagctatacgcgaaaaactcccatttgcggcgaagtgagccgcaaacctgtggagcttcgacccggatatgcatcgctgggttttctgggagaaaccaacgcatattcagaatacaatagcggccaagaggtgcatctatattctatttgggtcagcccacgcacgtttgatggcttttgtgaagctgtctgcggtaaaagtaatattgggttccgctctttccaaaaggattcgtattccttctacggctttaaaagcgatgcgcgggaagaaagcatcgtaaacaagctggatctctgcttcataaaagaaacaaatcaaataaataagcttttgctggaaagctatattttagagctgttatccatcaacattgacagactgctttgtaaggacaatggaaggaattccataagccagctttccagaaccgatattgatagtttgacatatgcacgcgagattctgctaaaccggctggaatcccccccttctctgctggaactatcccgtatgatttgcatgaacgattgcaaacttaagcgttcttttaagcagtacttcggaaacactgtttatgaatttgtccgggagcagcggcttgaaaaagcatttgcgttgttagagcaaggaaaacataacgtgagtgaatcggcctttgctgtggggtatacaaacgtaagccatttctcggaggcatttcaaaaaaaattcggtattctgccgcgggagatgataaggtgatcttcacaaaacagatttccacctattatccgtcagaagccgtgcgaaacggtcaatgaaaaggaggggcccgctaaatacgtagcgggctcctccttttttgcttttccattcttctatatttctgattctgcttcattcaaatgccgtcaatcgtcataaaaaagcaatccggtttttaccagcctgttttgcctgatacatggcccggtccgctctggaaaataacttttgataatcctctccgcccttttcggtaatggaaacgattccaatgctgacagaaagatggcccctttcttccggtattatcctttctaccttgtccaacagattctccgccctttcccggacattttcctttgtcgtaaaaacaacaaattcatcaccgcctacccttcctaccagatccggctccgtgtaaatatcgcagagcattccacttacctgcatcaggatcctgtctccggccagatggccgaaacagtcattgatttccttgaaattatcaatatcgatcatgcaaagccagccccagcctccgtcctttaatttttcttccacccggtattcaaaggctgttttgttgtataagcccgtgagtccatcctttaaagactgaagcaaaagctgctcttccctcgccttcagtccggtaatatcctgaagctttccaataagcttaacaggacctgatgtccgatcctcccactgagcggtaagcttgcagccgcaccagtgatatggttcacccatttttccaaggcaaaattcaaaggaacggatttctccgtctttgggagcattgtcccgatgctttgcaagaatcctcccaaaagtcctcaaatcgatctgtcccctggcatttggtgacagatatagcctctcatccatataagaatactcaaataaaaccgtatctttaaaaaaaccaatgtttctgtacatttgctccgtctcactaaaacggaagaactcatgctcgtttatcgtactccgctcctcgaaccgacttcctgaatttcctgtcatgatccttccccctgtacctgctggaatccttcattcagcatcttttccattcgtatatggtatatgataacgcttttcatccgtatatgcaaccagtttttcaaccattattacgcatataatacgtagcatctgcatagaatatcctttatgattaacctagaggtgataatgttggatgtacagtttgtcaggaatagaatcacggaacttcgcctgaaaaaagatatctccgaatatcaaatgagcctggatctagggaaaaacaagagctatatccagggaatttcttcaggacgttccatgccatctatgaaacaattttttgaaatctgcgattatcttgaaattactcccatagaattttttaatacggaaataaaagaacagcctcttctaagggaggccgctgcgctgatgaaagacttgaccaaagaagatttggaagcggttttccccatattgctgcggctcagagcaaatgcggacaatcaaaaacaggcagaaccgtaacttacggtcctgccttgttttatccgctaaacagctctagtattctctttcagccataaggcttcctccccagtgaaatacggggaaagggcctcataaacagccttatgataatcatttaacagctttacatcacgttctgtcataatggatgtatcaatggcttccagatcaatgggaaccatggtcaggaattcaaactccataaactgtccatactcgttcttttcagcctttttgcacacaaccaggttttctgtacggacgccgtggctgccctctatatatactccaggctcatcggaagtaaccataccttcctccaaaacactgttatcctgacgttccggaaccattcgccatctgattccattggggcgctcatggacattcagcaaatatcccactccatgaccggttccatggtcataattaatgccgcggctccagaagggttcccttgccacataatccagggtcagcccgcggcagccataaaggaatttcactgctcccaggcgaagcatgctgatgaccgtaagtgtaaaatgttctctctcttcctctgtcagcggtcctactgcaatggtcctggtcacatcggtggttccttcataatattgtccgcctgaatctaccagataaaggccttttgtctctattttcacatcgctctccccagtggctttataatggcacatagccgcatttgccccataagcggaaatcgtatcaaaactctgtcccagatttccttcctgccgggaacgcaggtcatctaaatactcctgtgcgctgacctctgtgatggtttcctttcccacattctgcttcagccagtagatgaattttaccatggccacgccatccttgatatgggcttttttcatgttttccacttccaccggatttttcatagcctttaacaaagcggttgggttcatcttatcaatgattttgttagaaccgtcaagattttttactatagcgtaattggtcctggctgtctctaaaaggactttttgattccttaactgctggacggctgtataaatatcgttataagggcatacagttacggaaaggcccttaaaataggctttcacctcttcctttaacaccgtttcattgatgaagagataaaagcggtccagagtgatcattgcataggaaagcactaccggattgcacaccacatcatttccccggatgtttaaaagccatgcaatgtcatccaatgtggtaagaatatgaatcgtcgccttttccttcttcatctggcttctcaattcttctattttctgagcagaagactttccaccatacttctcctcaagaatccaggccggctctgcagacagctgcggacgttccttccatataacatccacaagatcagtctgataagccagggtcacatttttttccgacagcagattttccagttcctgccccagctggcagtttatcacacggccgtcaaatcccaggcaaccgccttctggaaggacctgctccaaatattccccaatctcaggaacttccggctgtcccattttctgcagggtaactcctgtcccttcaagctgttttccggcttgtacaaaataacgtccatcggtccacaagccggccccatcctttgtgatcacagccgtacctgctgatccgctgaatccagtcataaattctctgcatttaaaatattctcccacatactcagattcatgaaaatccgaggttgggatcatataagcatccatttggtgctctgccatcaggcttcttaattgttccagtctttcctgaatcattgctttatctctcctttggtttcaaaataattctctatagccgccccaattccttcgctgtaggtgggatgggcacgcatggcaagcataagctgttcagctgtcagcccgtttgcaatagccgtcgccatctcactgatcatatccgttgccctggagcatacgatctgggcccccaccagagtgccggaatattcctcaaacaccagatggataaacccgttctgctccctgcttataatagactttccatttccgctcatggaatagcggccacagctcaccttcatgctgcaggctcttgccgcctccctggtaagccctacggaagcgatctccggttctgtgtaaatgcagctgggcaccacaggcagtttgacaaacatgccgtttggtaccacagaaagccggatggtatgctcaactcctgcaatcttttctaccacataagttccttgtgcagctgccacatgggccagcttgatatgagccgccacatcaccgatggcataaatcccaggttcactggtcataaattctgagtccaccttcagatgcccattctctgtttcaagatttacatcctgccccatcagcccatccaggcagggggcccgtcctgccgccatgagaacctgcccggaacggacggtctgttcctcaccgtccacttcaaacatacatatgagtccctgattaggctcttcccgtatctccttaacctttgccttgcagtgtatggcgattccttttcttctaagttcctcttccaaagcctgggaaacttcagaatccattggtcccaataagtgggcctcgctctccagtatggtcacatgggaacagagggcactgaaaatggtggcaaattccaccccgatcacccctcctccgatgatggtgagacgatcgtaattccacgtatcagaggccagcagccggtcactggtcagcactccgggaaggtctgctcccgggatctttaacgtcaccggcctggctccggcggcaatgatgatatgatccgcctcataataatccttgccctccgggccgttcacctcaatggtccgcccccggcgtatggtggctgtcccgcaaatgacggatattccggctgcctcaataagttcctccacttccttgcggtacgccttgacagaacgctttttataattctgcatctttttaaaatcaaatgaaataaaatccgtggatactccgaattcatcactgttttgaagcgcctcaaaaatactggaggcatggagcagcgccttggtgggaatgcagcccttattgatgcaggttcctcccagcctttccttctccacaatggcggtcttaagccccagaccggctgcttttaaagccgccgtatatccgcccggccctccgccgatcaccacaatatcataatgttctgccacttactcctcctatcggatcattccaaaatacaggcaggcttttttgattccctcctgatcaatcggatccgtgatataatcagccgctcttttcagctcagccatggcattgcccatggcaattccccttcctgccagctttataatatcgtaatcattcatgctgtctccaaaggctactgtttccgtaagagggattttgtaataatcgcatagcctcacaaggcccatggcctttgaggcctttcgttccactacatctgctccctttttatcggcaaacatatgtacatggatctccggaaactcctcttccatggcctttgcaccggcttcatccccgatataggccatggtgcggacttccagttccacaagctttcctggatcttcgaatcttcttccgcattctccccaaagatttgtgtcatgtctttttactacctccggatggacataataatccagatcccccacggtggtacccacgctgtgaggagttttctccgcataagacagaatctttcccaacagctccttatcaaaggtatgttcataaatgactttatctccaacagtcacctttgtcccattgagatggatgatcgcgtccggccttaccatatcccggatcccggtactgaaaacagaatccatatctctgcccgtcgccaggactatggtgtaattctctctcagcttttctatggtttccaaagcgctggcaggaattgtccagtccttatggtccagtaatgtcatgtctacatcaaagctcacgatcggtttcatctattttcacctttttttcttcctaaaataatctttctttaccataatatcttaaatttgaaattttttcaagaaatatactttaccaatccgaaactttctgctataataccatatgtgtcaaggaaacggagtatggcgtagcttggtagcgcgctcggctgggggccgagaggtcgcaggttcaaatcctgttactccgatcaaaataggaaatactggataccttattttacaaggtttccagttttttttcgtcttaaaattcccctcatttttcgaatacagttgaaataactctttgtttgtgtgtaatatcgacataatgcaacgtgacgaacaaaaagaaaaagacgatggtaaccaatcgtctttacatatttgagccataagacagttctttaatctcaatcacatcaacctaggtggcagcaaaaacatatgactgcttagtcaatacccaagagtctctctatgtaatactgagtatttataacaaaccacatttgggcatcaaatctcataatcgtccatagagatatgccgtggaaattatattctgccaccagaccggcccttgcgtcaaagcttcttgcatctttagtccatactacatgcagattctgatcgctatccgtatagtagaagtaagctgactgtgctggttcattaaattgtattggtacgccgttttccgctgctatttgtaccgcattattataggttattgcggcagcatctgtggcaccgggaacatatggaagtgtccaatcataacctaaagaagtaactcctaaataatttttttcaggaggaatagtattaaccatataatctaataaatctcttaagatattaactggataaattgcgcttggaaaactgtaagtccttgcccagtcatatgaagcaaatatgaccgcatctacaaatttagataaccttgaataatctattttttcaaagccaacgctggaatcaccaatattcgtagctggtgatatggtaatcattatcttgtatccttctgaatgaaacatcacagaggctctctgcaaatattctgcaatgctatttatgttgttataagtaatgttttcggtatatatgttaataccataaaaacctttcgttttcattatatgaagagcattctcaataaggctgacctgcacagagggattatttaaaatattataggtcacttcaggactgactattccttcttccgacatagtggaaacgagcatcatgggtgcaacaccataagatttggccaactggataagttcagtgtcgtcggatctgaagatgatttcaccctcacttgtagctctatagttgaatatggtcaaataagttaaaaagggaagagtttttattaaaacagatttatctatgtatgaaaaggtatagccaatagtggtaattgttcttgttttgtttgtttgatacttgatcactatggtttcacctacgtacagcattcccctatcggaaagatagggattatttcttaataattccattgttgatacatcataccgctctgcaatactctccaaagtatcaccagcttggatggtatagagtatttccggttgaacaatcacaatagtttgaccaattgctaaattatcagggtttataattccgttttctaatattaatctgttaacagagacattgtattgctctgcgattgaatagatcgtttcgtcgggttcaactacatgtgtggtcatggcttccctcaataatcttattaattctattatatgccaatactacctgcccatgacaatatattacaaacaattacataatttcttgatagcatacgaaataaggaaacatatattctattgaaaaaattattcaaacataatacttaatcacgaaaacaccaaaacgccgttgtactgaacaaagaagtcacagatgtaaccgtatctgctgatactaaactggaagtttctgatgaggctaaggtgtcagccataccagatggtgctgaatttttgaaaaaattttctgttgaagaataactgaacaagtggtaaaattattatccttggcaattgccaaaggattaaaaaagtggaccattcggtggaccaaacctatgatagggagaaagcattgaaataacttgaaataaatatggtcttcttataattgtgaaattaccttggctctgccaagggctttgcggcgtaattcactaacgtaattcactaacgtaattcacttaaatcgacttatgaaatccaggaggtgtgttttatgagttattatgaacttgacatggaacattatccgcgaaaggaacagtttgaccttttccgcaatctcgcttatccatatgtaggtatgactgtgaatctggatattacagattttatgagctgtatcaaagaagaagggctgcctttttacctgactttcctatacgcggcggcacggactgctaactctatcccggaattccgccgccgtctccgtggaaacgggatcattgaatatgatcactgcatttcttcctacaccctggcactggaaaacgaaagctattgctattgcaccgcagatgaccggctgccctttgatgaatttctaaaggattccaagcagcgtcaggaactggcaaggcagagccagactcttgcagagggtgaggatgaagaccaacgctttttcctttccagcattccctgggtaagctatacttccatcgttcagccggttccggttcctgcggacagcaaccctcgtatcacctggggaaagtatttcacctcagaaggagacataaaaataccggtatcggtcctggtgaatcatgcactcatggatggactccatatttcaaagttttattcaggacttcaaagcagttgccaccgcatggactggctggtgtaaaatgtttgaattattggaataatttcgcttgccttttcttaagttttcagttaaaatgcttttatggagacatagctcagctgggagagcatctgcttgacgtgtagagggccgcaggttcgagtcctgttgtctccattatttttgaaccctagtaaatacgagaactccttgtaaatactggggttctttaatattatgctttacagttatttgctgaataaggcatgtaaatacccataaatataatacgacatcacacggaaatgatataattcactcatttaaaaggcgggcccggaataccggatacccgcctttctaattactgatttgacacaacaatttcattaattattatattcatttacttcaaagtatgaaatctgatcgtatgcaatataatctttgcggcttgtgaacgatgctttattgtgattcttctcaatcatataggtcgggcttgatgcagctttgccattataccatatcataaagtcattgattttatctgaggtcatctcatattcttttcgttcgccagttaccatggtgattacaagaagagccttgtcgccagtcggctggtttgggtcaactaaagttgtcggagtggccgaagcttcattagaatccaccccctcacttccgtttatgattgcagttacaacataataatatgtagttccattggtaacgtcgttatcggtataggcagtgcctgttatatcagttgcaattgttgtgtatggggcacctgcaactcaaaaatgatacagcaaaaaataaaacaataccacaaatagtatgaatcaattataattgccaaactataatagcaatatttcactgatctcagagattaaaaagcgccgtcctgatctggcgtgagtgtcacaggctccgttgccatcttaactccattttattgcaatctcctcatctctaatgtataataattacaaaaacttacaataggggtttgtatgaaaaaagtaaaaattcttttaataacagcctgtatttcatatctcttctccattcagtcctttgccggttgggtacagcaggctaatggtcagtggaaatacgaccagaatggaataccggtaacaagccagtggattgaggatcagggaaactggtactatttagatgcaaatggcataatgctcataaacactacgcagaacattgatggtatagtttatacttttgatgcttctgggaaatgggtagatccaaacacttccaatgtaataacctaccgtactttcaccaatacagaaattagatattctcttcaaattccctccgatgtagccacaactgcttttgacggaaatacagaaacttttgatatatcctcgcaaaacatattaatctcatttaataattatataatacctgcacatcttgaccctcaagtatgggcagccgcttttgaagcaggatttattgatggcataaaaggaaaattatcttttattgacaaaaccaacacccaactaggtgaatttgcagctactaagactcgatatctttacgaggataatatcagccttgatttttacaattgcacccggggctataaaacgtttgttgtttgtgccatgtacatccctgaaactcaggcaaaggttcaagaaattttaaatacattaaaagaactacaataatttatagttattaaagttgcccgcctactgtggcgggctttttttttgcttaaatatcattatccagatcaatcgtccatattaacagtgaacaaatccctcagctatgctaacagactctcaccagcactccgcctgccgtattgtctaaaaagtaccaatcttaccagtatccaatatcgttactgagaaggtcatggcaggcagtccttacaggatgtaattctgttttgtagccctggcatgttccgcagaaagcatggctgcatgctcttttttactgctcaatttgtcaccttcctctggatattctttaaattattttctacactgtaattataaattgaaaggcggtttatgtataaatgattaacttctttcgttggtctcggttgacctctgtatatgattcagttgataaaaatcggattcaagaaaatctttctaaaaataatatagcatttaaagttaaagtgagcgacttatctgccagaaatccattcgattttccccatgcgggaataggaacaaataaactgaaattatcctatacattttatgttaaaaaacaagatgttgaatttgcactgcacttattgaaatgagccgtcatatttcagttttactgcattaaaaaactactaacttaatatttcacagttagtagttaattgacctcttatttgtattaaattgatatttaatttcctttgttattccagacactagctaaaatatctttgaataccaaaaaagcatctgtatcattatatccatattcctttttcaagtgatatagcatttctcttattttaggaatataatcattaacattaacctcttgctgataagttgttaaaatcggatacttttcaccccacacctttgtccaatcaatttcctgttgcttttcttcactggtcttttcaataacctgctgtatttcctttaaatcaatatcaaactctatcagttcatctaaagataaaccatatatagttgccaacttttttgattggcgtatgtcaggaagcgtttcgtcgagttcccattttgaaatggtttgtctgctcactcctaattcttctgcaacttcttcctgtgacagccctcttttctttcgtgcattgaacaaattacttcctaagttcatcaattccacctccaaatttaatataagataagtatatcagtatatagaaagaaatctaccagtaatagtctgcacttatgcactttttcttaacattctttagagttgaattttgattttctaacctaaggatactgcagtctctactaactatcaatattaagttatcaatgtacaacaaattaactaaatcttaagttactggtttaaccacttcccttagcctacttttccattttttaatttactgtttattaccattatatttttatagattatgctcataataatattgtgttcatcaaaaaacacatcattatagacggaggtgtcaagctatggatggcaatgcggaaataacaataggttgttaatgaagtattgttgacagcttaaacctaggtcagaaaaatgtcctcatactaatcttgagggcatttttctttatagcccgttcaaaatagggatgtcaattaattttcagttacatgaattccttgtgagttgcagctcctgggatttcttttccattcttccggcatatatcaattatcctgatcaattcatcatgaaatttcatctattatcgtataccattatttgattctcttcttgttttgtaaaatcacctccatttttagttctgaaaaaaccgccaagatatattgacttgcttctgaaaatattctatgattaggttgtcgatcaaaattaccaaaattttccacacattattcattgctatgattatgcaattttttcaggatgtttaaaggagtgcaaaatggacttaaaagagcgtatcaaagaattatgcaagaaaaataatatttcaatgaaccagcttgaacaagaacttgactttagcaagggatatatcagcaaacttggaaaaagcacgcctaatgctacgaaaatacaacaattagccaatcgtttaggggtcacagtagattatcttatgaatggaaccgtgaagagagatgatagagagtattactatactaacgaggaaacctgtaaaatagctcaggagatttttgaaaatccggatctgcggtcattattctatgctgcaaaggacttgtcatctgaaaggctaaaagcacatatagactttatgcagtctctgaaacgtcaggaagaaaaatataatgatgaagggtgttgacgtaaatgaatacacccattactcacagaagcaatcggagtttactttttagatttggatagcgtaattgaggaacaagtgatctctaatagtgatgggagttttactattataataaattcaagactgaaccaggaacgtcaaatgctagcgtaccagcacgctcttttacatattgccaatgatgattttagtaataagaatgtcgattctatagaactggccatgtaacaaatgacagctgattaaatagcctatggctttttaataatatgaacaaaagaaagaaggaaatgagtatgggaaaagaaaaaccaacaacaaaaatttgtaagcattgtaaaacagaaattccttatggggctaaagtttgtccgcagtgccgaaaaaaacaaggattgggaggatgccttacagccattataatatttattgcgcttggcttacttggctcctgtttagctggtaaaggcaatgaaacagttaatactagttcaaaaaatcaaatagtgtccgaaaaagaagaatcaacagaaatgcaggcagaaactgaaacctcagctgtgccaaatgcttctgagtcaggaactgattcctcacctacagcagatacctctgctccggatcaaaaagaaactgcagaattgactatggggcaaaaaaatgccctgtcaaaagctgcatcttatctaagtttcacagcattctcttatagcggtttaattaaacaattagaatatgaacaattctctacagaagatgcgacatacgcagcagataattgcggagcagattggaatgaacaagctgcaataaaggcacaggcctacttagatatgagttctttttcacgaggttcactaatagaccagttgaaatatgagggatttacccaagatcaggcggaatacggtgctactgccgtaggttattaacaaatagaaaaaccgcccggtgctaccaacaccgaacggctttacatagattttctcttaccaggtaagcccagaaagatatatcaccttagacgagtgaattatatcattttcggagcgtcctggcaaggggcgttatttatatactcaaaaacagattggtttctcctgccgtgctgcattttttaatatgcggcacaaaatgcagcacatttaataaaattggcgggcccggaataccggatacccgctattttatattaataacactttcacatacaatttgtttctcaaactaacgtcaattactctcttactcttacatatacctgaacaatcatgtttccctcttcatccgttgcggtatttaagctaacccttcgcttactgccgtaacccttcctttactggaaactttctctattgatgaatccatcaacttctaacattcctataccaaaaatccatgtagtcagactgtaaatgcgagaatacgctatacaatccctgccgactatcacaacagccccaaaacggtgtctgtaaacaatctggtactactctcagttcgatatggctccagagtattaattataattgtctgctcacaaacacactttccttccgctctgtgtataactaacggttgtaagcctgtaataatttgtattattgtgtcgtattttcagacattaacaatcaatccacaattatttccacattattgtggataagtgtcgttttgagaacacaaaccttaacgcccccagcctcgaattatggcgcaaactcgtacatgtatattccggcatcaacgccgataaggttaaatgaaccaagcctttttgaccattgcggcctctgctaaggccgtcctgtgagtttctttcttccgattttcatttgattattatctcaatctattaccatttctttgtttgacaaaaaataacatgtatcttgaatcaacacatatactataacgattaataaaaatcccaagaggccgccaatgcccataagtgatttaggtacaatctcacaattgggacgaatactgcaagttaataatgcaatggttgcagaagttttcctccgcagtaaaactaccggatatataaacattatctttgccaggactgaacaaaatcagactgtatctgaattcttaaggcttaatgtaagctttgagactgccattttaaattcatccggccaacatatgtgcttatgcgacatccaaaaaggcatgctggtagactccttattttcgccaatcatggaaagacgcattccgccccaatccaacgcctttttaattgtcgcaagaagttacaatcagccgccgctggactccattacaggccatatcacaaacgtagatattgaaggttattatttctatcttgctgatccttacaatacagaaaatcaaataaattttttagtcagcaataccacttcgattcgcgatagaaatgggaactctgtcccctttcgttcacttcgccccggtttattagtaaacgtgactcattccaatattgaaaccggggatattccgcttcaagctgacgctttccatattcaaacaatataaattgtatccaatactgccagcagacctcagtcagcctgctggctatcgctttatcctgattataattgcagccggcaggattcacccaatcttgccggctcctccccttttatggggcagcctttctgttatatgatttacatatcagattgtaatcctgttatctccgtttctattcatctcaaaagcaccggaagtccatgtaaataccatgacttccggtgcttttattttttgttgaatcactcagtttttctttagaactgagttggcacaaccttattctaaagaagcagccacttcatcaaccattgcattggtagccgtaatgcctccggatacaacataccagtttgtggaatccagataaacgatgtgatcatttgccgccgctttcgttccattcatcagttcattatccagcagcttttgggcgccggtggcttccgcagcgccggtggcagcaccgcgatctataacaaacaggtaatcaggatccttttcagccagatattcaaatgtagctgtttggccatgggtagagtcatcaacctgatcgtcagctacctgaaaaccaaagtcatcatatacaattgaaaaacgggatccctgtccgaaaacgctcagttcactgtcatttgccatgattaccattgcattccatttaccagctgttaccttttcgttaaccgctttgatttttgtattaatttcctctgccgctttggagaatacatcagctttggacgggaaaatctgagaaagaatattcagatttgcctgaaagctctcaaaataattggcggaaggcattgtcatatgtacggttggtgcaattttagacagctcctcataggactttgctgccctggcgctgatcaggatcaaatcaggcttcagttcgttcaccacttcaaagtcaggctcatgtaaggaacctgcaaccttatatgcttcaccggaaaatttgcttaagtgttccgccagattgccgcccatgccaagaccgatcacatcaatccccgcataatccagagcatccagtgtgccgtaatcaaatacaactatacgcttaggttcggttgtcagggttgtttcccccagatcatgttttaccgtgatctcctttggttccgtgctttccgcctcagtactgctttccgctgcagcactgctttccgcctgggaagttggcgcagcggaagtattcttggcggagtcagtccctccgcagccagtcatggatatggtcatggcaagacctagtaacattgcagctgccttttttttcataattgaatctcctttcaatactatacattttatttgatcagccctaacggccaatgcaactatttgaaatatgcgcataagcgcataccgtctacctcatggatggtaaaatccatgtcgtaaactttgtttaattcctccggggtaatcacctcctttgctgttccgtttttcaaaagcctgccatcctttaatgagataatgtaatccgaataagccgccgcaaaattgatatcgtgtagcaccagcaccactgtttttccatgctcatccacaagggtgcgcaaaagccgcatgatctgaacagaatgcttcatatccagattgttaaggggttcatccagaagaatatactctgtatcctgggcaatgaccatggcgataaacgcacgctggcgctcgccgccggaaagctgatcaataaacgtatccccatagcgctccatttccatgtaaccgattgcttgttccacaagctgccggtccatattggtgagctttgcctgagaatgaggatatctgccgaaggataccagttccctcacggtgagccttacacccacatggtttgtctgacgcaaggtggacagcttttttgcaagttcactgcttttaaaggaggatatggactttccgtcaatgctgatttccccttctcccggcatcagacgggaaattacggaaagcagcgtactcttccctgctccatttgcgccgattaaggttgtaacggcattcttttgaatgactgtgtcaataccggtcagaacctgtttttcaccataacgttttcctatattttttgcaacaatcacatgcgtccctcccgaatcaaaagaataataaaatagatgccgccgataaaattgatgatgacgctgatgggcgtgctcagtgcaaagacccgttctgccataaactgtcctcccaccagggccgctcctgcaaccagaactgcggcaggaattaaaatgctgtgtttataggtggcaagcatttgtctggcaagattggcggcaagcaggcccaaaaaagtaataggtcctactaatgcagtggaaacagcaatcatgacggacacaatcagcaagtactttttgacagaactctgatagtccacaccaagccccaccgcaatgtcctggcccaatgacatcacatccagccggtggatcttatggaagcccaaggccgctgtacaagccataagaacggtagcaatccccagaagggacgtattcacattgttaaagcttgcaaacatccttgcctggacaatcataaattcattgggatcaatgatgacctgcataaaagtggcaagactggaaaataagctgcctaacatcataccgatgaaaatgataacaaacagacgggtgttctcccttttaaatacgaatctgtaaagcagcaggctaaagcccgccatgatacagactgagatgaaaaagtctgttattttggacattacggcaagctgtttggctcccatgataaatacgaccagtgtctgtacaaaaagatacaaactgtccagtcccatgatggcaggagtcaggatacggtttcccaccacggtctggaatacaatggtagaataaccgatggcagctcctgttacaaaaatggccgccagcttaaccagccgtcttggaacattatagccggcattatccggattcaagccccagacaacgtataagagcgaaaccacaaacgtcaatagaaaaagcaaaaacaaaatcttacgcagcttcataaaccctccttcctgcaagcagggccagaaacagcccgcagccgataatacctaccgttacgctgatgggtatttcaaaaggaaagatgatcaggcgggaaatgatatcgcaggccagcaaaaacagaccgcctaacaaagcaatatcaacaatacttttgcgcaggttgtcaccataataaagccttacaatgtttggtataacaatgccgataaaggggattgccccaaccgtcaccacaacaaccgaggtcatgaccgctacgatggacagccctacctgcacggttgtaaaataggaaatccccagattgccggaaatgtcttttcccatggctaccacggtaaaacggctggcgtaaaacattgccaataccagaaaaggaagtcccagatataaaagctcataccgtccccgcagcaccattgtaaaactcccttgcatccatgaggttatgttttgaattaagtcatggcggtaagcgataaaggttgtgaccgcccctaccacatttccaaagagtattcccacaaggggaatcaatgcagcatcccgcagcttaatcgcctgaagaagctttaaaaaaagcatggttcccagaaaagcggagccaaaagcaatcagcattttaacaccaggggccgcaccaggaaatagtaaaacggctatcagcacgcctaattttgcccactctgtcgtggagcctgttgaaggggaaatgtagcggttggatgccagcatctgcatgatcacccctgatacggccatgcccatcccggctaccaaaatgctgatcagcctgggaatacggctcacaagcatgattttcatttggtctgcctcggtaaacaggctttgtattgtaatatcttttacaccgataaaaagagagataaggcctaaaataataatcgcaagtatgtaaacaaattttttcattgaatccccagtcttgacactttcgcgttcataactataatagtaagtataagttagttttagctaactattgtagtatactgattcagagcatttttgcttgtacaatattgacctatctttcacaatattgaccttgaaatgtaaatacggaggaaacatggataccattaagagaattttagaagaatttaatgcctgcaccaatctggcagtacgggcatttgaccggtttgaaaactgtcttatgatatgtgccggccccaccaaccgcctgtgctgttaccccttgtggcgcaaaacggtatatagggcctgcgaattgcttcattccggcatggaccaggatcatattaccctgcaatgcgatatgtgcccatgccccatcatgggcacatcaaaggctgagctgtcctttacggcctgctatatagaccctgcaatgccggagcttggcacatttgttttcggaccctatatacagaatagcggcgaccccttatttcccttaaaacctgctgaagtggtgccgcatttaatatctctgctccggatgatctcccaaaaacatctaaagcaggatctggagtttcaaacaaagcaagggaattcctatcagatttaccgctgcattgagtttataaaaaatcagctctggggcagcgtgaccttacaggaagccgctgattatttaaacttaaacccatcctatttatgccgtttatttaaaagggaaatgggttgctctttttcacaatacatcaaccggcttcgcgtggaacgcagccaggtcctgttatgtgatcagacctactccatgctggaaatagctctggccgtaggattctccagccagagctattttaaccgtgtctttaaaaatgtctgcggtaaaacaccccaggaataccgggagtgcttttgccagatttatgataattcccaaacttccctggcaatctagaccggtggcatcagcagtgttccgaaaacagcgatgggaagcttgttttccggccataatgagccaaaagcataatttttttaaaaaaaaattaataaaagttctttcatctgcgtcacaaaagtgatttttttccgttattatatatgtgacatcattcgggcggaagttctcctttgctctgcttccgcctatcccttcagcttgttcacagaattcgcctaattacatatattattattacagaacgacttatcaaagaagcagcggaaagaagcgttgacaactctcagccgccgccttaccaaagatagataactcattttgatttatgtctcttcttttcctgtactttcgatgagaagtcctgtaaaactgcccgatcataaatatgaaacctcaaagggggggaatccatggcatcttggtttccacccctttaaagaattaatccgattttctttttgtattcggtcccataccttcccggcgggaattatgggtctgattctgattttccggtttgcctttttctgacgtgccgtgaaacatttcatttgagtttttctgggaaagcttttcccggctattcttttccatttccatcacctcacccatagtattgcctgacaacataagatttatgtgaaaacgcctttttcacgcataatccattccatagctgcgcattataaaattgaggtgatgaacatgtcatatatagctcccgcagtccaggcaaaattcgagactctttccatcgacttaaaaaatgagatcctggagcgaaacgtacaaattaacaccatttacgatttgatccatgttttggaggaaattgtaagcgaaggaagtaaatgattctcctaaaaaacagtcacaagccgaaaccggccttatgactgtttttttgatgccatatcttaaaccacttacatagaaagagggccggacacaagcgatccgacccattaataaacgtaaaaataattatctccagtagttataggaggacttacactgacggccgctgtttgtggctgcagctttggtcttggaacaggagctgctgtttttgccggtggagcagctgttcttgccggtggagcagttactgccggaacaggaagcaccctttgtgcaggtagacccggtggtgcagttagagccattggtacaggttgtaccgttgctgcagctattaccgttggtgttacagccgagcttgcttaaaatgctgttaatatctccagactgtccaaagcaatttgaaaggttcgtgtaattacttgttgacgtcgggcaggttgctgcctgcgcggtcataggtacacctgctacggtcaatacggttgctgctgctaaaacgaatactggtaatttcctcatggtaatatcctccttatttgttacataattattacatttctgttacaaaatgtataataacatacaggaaatggaatttcactaggagaaaaatggcaaacttcctctatttttccagttggcactcgttaaccgccagttttaaagctcccataatgccctgattatcatttaaactgggaagaacgatataatgttccatatcctcaagttcttttgtcctgatatatccggccaactgacgcttcacttcttctctcaccaagggcatcatatgttcctgatgcattacacctccccccagaataatgcgctgaggagaaagaaccataatgtaatccaccagagcctgagcgatgtaatatgcctctaattcccatacttccttctgaccggccagctctatgccctttttcccccaccgcgcttcaatggcaggaccggaagcaaggccttccaggcatgtcctgtgataaggacatttcccttcatagctgtcgtccggatgcttggacagcagcaaatgtcctccctccgggtgcagcatgccgtgaagcagttttccgttggaaatgatccctgctcccacaccggttccaatggtaatatacatgctgttttcaaggcctttcgtaataccccaggtggcctctcccagagcagacccattcacatccgtgtcaaatccgaccggaatcttaagggcttctttcaaaactcccacaatgttataattggcccacgcaagcttgggggtggtggtgatgtatccataagtctctgagttcctgtttaagtctatagggccaaagcagccgattcccagcccttctatttctttatccttaaagtacccgatcagctttggcatggtgatttcgggcgtttcagtgggaatggaaacgcgttcaaaaatttccccgttttcatttcctatggcacaaaccatctttgttccgcctgcctctaatgctccaagtctcatatccttttgcctcctctttattctgggttggaacagatgatagacatctttccctcaaatctgcactctccgctttttgacggcacgatgaaatgctgccctgcctccaaaggaatcccgtttacggaaccttttccgcttatcacgctcacattggcaaaatatttcccaaactcctttgtaaacacaccctcaatatcatatttatccactgaataaaactggcaggtcaccaaatgggtgtgcactgcacctggtattttctctgtttccggatcaatctgttcttcctcaaaaggcgcctttatgttggcaatgctctcttccacatgaagctgccttggttttccgtcggacaaacggtcataatcatagacccggtacgtaatatcactgctttgttgtgtctcaagtaccagggttccggccttgatggcatgaacacagccaggattgatttgaaaaaagtctccttttttgattggaacagtccggataaattccttccaccggtgatcccttatcatggattccatttcttcccgatccctggcatgatggcccaccgcaatttcagttcccggctcacagtccagaatataccagcactctgtttttccaagagagccgttttcatgaagcttcgcatagctgtcatcgggatgaacctgaatgcttaaatcagctcttgcatcaatgattttaaccagaaggggaactgatctcccggataattcccaaacagctccggttcctctttccacaggctgctaagcctcctgccgtcatatattcctcccgcaatcttacattccccgttcttgtgggcgctgattgcccagcattctccggtggtatcgcttggtatctcatagccgaatacatcccgaagtctggttccgccccagatggcctccataaacacaggctccagaaacaaaagttccatcagttttcctccttatgtagtgatttatgaccactgcctatattttacctgaatataggaaaaaggaaaagaggtatttctactttttctcaaaaatgggggaaacagaaaaaagtgccggaatgtccgttatccggattcattctgacactttttccttcttactgtgaatcttttccgtatacctcaatctgggtaagagccggaaatggagatggatcatctgcctttatcagatcacttaatttcagccatgtgatattctttttttccattgtgaacagatgaggctttacgctcttttccatttccaccacctcctgggttccgtcagaaaatgtaaatctggcttttacccaccagttgtcatgagggaaatctgcacgtgtgtataaggcaattttatcaaaatccacgggacgtccaaaatccagggtcatttccgcatcatcctgacggtttattccccaggattcataaggccaggcaccgtgggattcgttggcgagaacgccgtcaatggcattgcgggccgcaaataccgcttcgcccctggtttccacattggcaaaggcgtgagggaaacagcccgtatccccgtgctggtccatgacattctttgctaagttccggtaaatgcctgtttcatagtcaaaagccacccgaatggccagataatgacgcccgcctgtaaaggcttgggggttatatgagatctttttctccccaaagggtatggtataaacgatttcttcctttgtcagataaacaaatgactcatccatacagtcatcgatgcgcaccgaataatgagctcctggcttgtctgttgtaaaaacaatgacatcgccttcttcgtattctccttcaaacaccagaattgcctgatcctcactcaacgcggaagccttcaccccgccattctggtttcttacagctattgatacattcgccatgatcagtcctcctgctcttcctgttcaaaataatctttatattctacttctatctgatacttcatgcgcttcatgctgtaatacagatgttctctgagagaccgctccagaccctggatgtccttcttctccagcagatcaaaaagctcggtatgctctctgatgatccttgtaaaatccgtttcagttacaaaatccagcatacggaaccttgtataatgtaactgctgagcctgtatcatatcccaaagctttttctttccggtagcctgataccaaatggcgtgcatctgggcatccatgcggtaaaactgctccggttcaaaccctttttcctgaatcagagcctgctgcttgcggatcatgtaccggacttcctccatccagagaggagttaccatatccataaaatcccgcatgaccatggtttccacagcaacacgcatgtatatcatctgtttaatattatccagattcaaaagcgttacctgtgtaccggaatagggcaccgaattgacaaagccctgctcctgaagccgtcttaccgcttccctcacaggcgtccgggacacgccgaaccgttcacagatttcattttcgctgatgatctgtccgggctttaattccaggtccagaatctcctgctttaaggtttcaaacaccagttcaccgcggtttttataggttttggtctttccttccattgaaccctcgacctcctctatattagatccgttaaaatatgccatgacctccgccctgagagcggacatcatggtcatattttaacatcaggacctgcccatgcaaagggcctgcctgattattgaaatctgattattactggggctgcttgccgatgtaagctaaaataccgccatccacgtacagaatatgtccgttgacaaagttggaagcgtctgaggaaaggaacacggccgggcctgccaggtcctctgcttctccccatcgtcctgcaggagtcttggaaataatgaactggtcaaagggatgtctggaaccgtctgcctgagtctcacgcagaggtgcggtctgaggagtggcgatgtaaccaggtccaatgccgttgcactgaatgttgaattcgccgtactcagatgcaatgttcttggtcagcatcttaagtccgccctttgctgcagcatatgcggatacggtctcgcggccaagctcagacatcatggagcagatattgatgatctttccgtgaccctttttgatcatggacgggatcactgccttggctacgataaacggagcgttcaagtcaacgtcaattacctgtctgaactgctcagctgtcatatcgcacatgggaatacgcttgataatgccggcattgtttaccaggatgtcgatcactccgacctccttctcgatctgagctgccatggcgtttacgccctcttcactggtaacgtcacatacgtaaccatgagcttcaattccttcttccttgtaagcggcaattcccttatccactaattcctgtttgatatcattgaaaacaatggttgcgcctgctgctgcaagaccttttgcaatggcaaagccaatgccataggaagcgcctgtgattaatgcaatttttccgtcaagggaaaactgatttgctaagtaatccttattcatgttcaatctctcctttgcttattttttgggggtcagttatctcatgatacttgtgttttgaactgtattcaaactataaaatttgtatacaaatctagcaccttgtatatatgctaacatatccaatttcttttttcaatgtacataattaacaaacaatgctcattttatttatctataattttccaaggaacagccgcctgtaaaaaagaacagtctgggttccttttctgcaaactgaacagaacacgtttcgttaatttttcttagggcatgtctgaaaactcattgcccgcacaaatgaaaaatcccggcttccgcaaggaataccgggatttttatcatgcaattttgtttatgattgataccggcttttgacctcagtcttccagagtcatcattttccggtttttgaattcctggatctttccttcattccagtcatgtacggggcggtaatatccggcaatcctgctgtaaacgtctgtctgcttaccgcagaccgggcatatttcctgttctccggaaagatagccgcaggtctgacagatggaatagaccggtgtaaaggtgaaatatggtatgcaataattttccgccatctttcttaaagagtcccggatctttctccagtcctcctcttccttacccatgtaaacggaaaatacagtgcctgccgtataaatcggctgaaccgcattctggttttcaagagcttctgaaagcgttcctccaaaatcagaggaaagcttggtactgttggtgtaataagggacatccccttcttttccccctgttctgatctccggaaactcatttttgtcgatcattgccagacgataggctgccgattccgccggggttgcctccagacagtacagacttccgtattcctgctgataacccagcagcttctcccttaagtggttcagcacaccagccgcaaagtctctagtcttttgcgactccattccagccttcagccaggcggcgttaagtcctgcctcattcattccgataaggccaatggaagaaaaatggttttccaggctttccagataacaggccgtatagggataaagcccattctttaaaagccggcagatcacatcccgtttgatctttaaggatctggccgcaatatccgccgcctgatccagacgctggtaaaaattccgctcatcagatgacaaatagccgatccgtgaaagatttatggtgaccacgccaatggacccggtattctccccatatccaaagaagcctccggcctttctgcgcagcttcgtaagatccggggtcacaccctgataggagatccgcacatcccccggcacctggccgcccctgatatagttggaaaagtaaggcgttccgtaatgagaggccagagtgaacaaaaggcggttgttttctgtatctgaccagtcaaaatcctcagacagtccataaacaggaatggggtattgaaatcccattcctcctgcatctcctgccatcatggtctctaaaaatgcccggttgatcatatccatttcagcctgacagtccccataagtaaagtccatccgccggccgcccacaatggccctttcatccttcatatcctttggaattgttaaatccagggaaatgtgggaaaagggcgcctgggtcccccaccggctgggcgtgttcacaccgaatacaaaagcttccatgcactttttcaccttgtcataggaaagaccgtcggcccttacaaaaggtgccaggtatgtatcaaaggatgagaaggactgggaagcagcccattcattctgcatgatccccagaaaattaaccatttggttgcacagggtggccagatgctttgcaggagaggccgtaatctttcccgtaattcctccaagcccgtctaacaaaagcctttttaaagaccagccgcagctgtatcccgtcagcatggatagatcatggatgtggatatccccccggttataagcatctgcgatctctttgtcgtaaatttcagaaagccagtaatttgccgtcaccgctccggaattgttaaggatcaggcctcccacggaataggtcaccgtggaattttcctttacgtgccagtcctctaccttcacatagttgtccaccacatccttataatccagagtggtggctcccagtcttctgatcttttctctttgcttccggtaaaggatatacgcttttgccacatccgtatatccggtctcttccagaatcttctccacgctgtcctgaatatcctccacagccacctggtcttcctttaccttatctttaaaatcagaggcaacccttaaggccaggagttccacaatactttccgtataatactttccggttgccgtaaacgcctttttcatggcttccttcaccttagataaatcaaagccggcctctgccccatccctttttataacctttagcatgtcagtccttctcctttaaatcctatttgacctggtagatcatgatgcggtccctactatgcaattcctgctggaaatatccgctctccccatttacctccaataccacctgtccagttacgtttttaaaatccagtccggaatattccagcatgtccatgagataataaggctggtgatccggttttaaaggaagagtcaatgggttgtcattcagaaagaacgtaattttcccttttcccccacggctgcctgctccctttccattgcctgtctgagagacctggtttgtggctgatatagacggcttaaggcggcttggatcggtttcttccggctcttcctttttttcagcagcttcctcttctattacaatggtgtcaccggatttcagcaataaatcctcccttgcctcctcaccgttcaccagcacctttttcccttttccaatctcagccacatcagaaagcatggctgatgcgctctttccatggctggcaggtatgaacacgatccagtcttccgaatttacaggatcagaaagctgtgcttcttctccattgagctttaagacagacggttccgctttttccccgtaaaaaaccgttctttttccattgacgctcaccaccagattctgcccggagcgcccgatcatgtcctgataattatagccgttcatcatcagaacatccattacggtaaagctgccgcttctgaaaagctttgccggcttgtcatttaaaatgacccggaagctgtcattgacaatgttaaagcctgcagatatgacaatgccaagaggagtggcatattccgggttttcaaggtcatactcatcggaataggcattgatcttaaaattatttcccgcaatggcaacacgcttggagtcgattttcaaatgctccacgatcccctcttttaagccggagagtctgcttcctccccctgccagaaataccgccgacggcacacttccgtttacctccaggatctttgcggatatttcctcgcaaagtctggaagacgcctccttaatgcactcaaaaatggattccctggtgatggtctgctcaaatcccagaatgtcggaaaaatgtatctcctctgcctcatcaatttctgacttgattttctctgcggtatcgaaatctaccagatattccttcataatggtctcggtgatctcatctcctgccagaatggccatggtataaccggtgacacttccatccctgcagaccgcaatatcggaggttcctgcacctatgtccaccatagccagatttaacagacggatattctgaggaattgccgcattaatggctgcaatgggctccaaggtcaggcttgccacctccaaaccggttttgtgcatggccgcataaaggctttccaccacctccgtaggcaggaaggtggcaatgatatctgcttttaagacccttccgtgatggtcgatgagattggaaatcatatagttgtccaggtaataacggcttaccgtataacccaccaggtagaactgccggtctgattccctgccttctctattcataaataacttttctgcttcgctgattgcccccgcttccagacggcttactgattccgcatcgattttctgaggtctggaaagctccatctcataagtcacgctctcggtgcgcagcgctcttcccgccgcagccacgcagaccttgttaagcctgcatcccagcttcttttccagcctgtccttgacctggcctgcgatctttgccacctggtcgatatcctcgatctggccgtcaatcatcgcccgtttcgtgtgctcggctctctctatggcaacgatatgaattctgtccccgtcaggcatgcccaccatgccgatgatgctccgggtaccaatatccagagcaaaaacagcctgatccggaagtgtatctgtcaaaatactatgtctgttatccataaataatgccccattcccttatgtatttgtctattattctactagtataaacagcctccgtcaatcgaataaaggaaacttttgcggaaaatactcgtaaaatgacatgaaaaaacaggccgcagcttaaggattcgcgctgcggcctgtttttatcagcactgatttctaatatcaaagcttggattgaatgcgtagaaattcctgctgtccagattatcctgggtgattcttaaagcttcaccaaacctctggaaatgaacgatttcccgctcccttaagtaacggatgggatcgcagatctcaggatcagttattacacgaagaatgttgtcataagtgctccgggctttctgctccgcagccatatcctccaccaaatcggtaatcgggtcaccttttgactgaaattgattggcattaaagggaactcctccggctgactgaggccagatacccgtggtatgatcaatgtaatacgggccaaagcctgattccaccacctgctccggcgttaagtttctggttagctggtgaacgatggctgctacgatttctaagtgagcaagctcctccgttccaatatccgttaaaagtcccttacattccttataaggcatggcatagcgctgggaaagatagcgcatggaggctcccatttctccatccggcccgccttaagtcaaaaacagatgaacagactctgcactctttccccgctcatattgccctccgtttccccatatatttataaaaaccttccttttaggaggctcgtatgcagacaatctctcaaaaaaccctgacggatatcatgcgctacaatgggatcactgttttcatctatacaattcattatccccagtttaccaccacatgcaatccggccgccgcacagaagatcaatacattctatgaatttcaggccagacagaaagaggcttactgccgcacagagctgtactctcaggccgtagaacaggtagaatactcccaggataaccagtttccatttcataactatgaatttttatcggtctatcaggttacatacaatgaggactgcgtcaccagtctttacaccaaccagtatacctacctgggaggggctcatggaaatacaatcagggattcccagacatgggacttttgtaccggcaaccagctgagcctccttgatttcttcccgaacaatccaaaatttacggattatatttttaatggcatccagcagcagatagaagaacagctaaaaacgtcctcttcccagtactttgatgactatccttctctcattcgcgggaattttaatatcaacggattttttgttaaacccacgggaattgtcatctactatcagcagtacgatatcgccccctatgtaagcggaatcccggaatttttctttcctttccaagactgttctcccaatgcctgaccttgcctgtttcctggccggatccgcagttccggccaggcttgtccgccatcaattccgcgcctttcctctattttccgtaaatccagtcgatcatatgtaccgcattcaccattcacaaactgttcacagttatatcaaaatttcatcacatttccccggtatattagtaagtgcaaaaggcagtaaccttttaaataaaactttttttcatacttggccggcaggatcccccatcttgccggctccctccatatctggcctgatttctttcatcctcagtctgaggcggccattctttgaaatccaatggatcccatcattttatcctgaatcatcaacgcaatttccttgcgcttttcttctggcagagaattcataagaacatcttttccgttaatttctatgtaattttctataatcagctttttgttcatatttcaatcccctccctggtaaaatgtatgtgacacggattgtacttgtttccggatatttcccagacgcaaaaggaaagaggggatggattttgagaaaaaatgaaacaaaggaaatcggagctgcttacatccgcgtaagcacaaacgaccagacagagctttctcctgatgcccagttgagagaaattaaaaaagcagcagaagcagatggggtcctgatcccggagaaatttatctttatcgaagaaaaaggtgtcagcggacgccgggccgacaaccggaagcagttccagaaaatgatctccattgccaaatcccagccctcccctttccagtatctctacctgtggaaattctcccggtttgcaagaaatcaggaggagagcatgttttataaaggcgttctccggaaaaagtgcggcgtgaccattataagtgtatccgagcctattatggagggtatgttcggccgcctcatcgaaagcattatcgaatggttcgatgaatactattccatcaacctatctggagaagttaccaggggtatgacagaaaaagccttgcgggagggctaccaggcttccccatgccttggataccgggcggttggtgaaggaaaaccctttcttatcgatgatgcagaatataagatcgtggaatacatccatcaatcctatcacagcggcatggatctgtccgccatcgcaagaaacgccaatgctcagggctttctgaccaaaagggggaaccgctttgaccggcgggccattgagcgcattttaaaaaacaggttctatgacggaattgtcacctggaaggatatctcctttcatgggcagcatgaaaccaaagagaccgtaacatcggtttttaaagacaatcaggcacgccttcaaagagaatacaggccccaaagccgccgggaggtgtccagctgcaggcattgggcctcaggcctattaaaatgcgggtactgcggcgcaagccttgtatttaataaagccccggatacaggccgccatcccagttattttcagtgctggcgttacgccaaagggcttcatgaggaatcctgcagcataactgcccataagatggaggaccttattatagagtcacttcgcaatgcccttgcctccgaagaaatgaaatacacctatgtacgaaaacctgttgccaaagcgtaccgtgaagaagaaaacatacaggcagccctgtccaggatcagccacaaaaagcagcggataaaggacgcctatgaaaatggaatcgatacactggaagaatacaaagcaggaaaaaagcgcataaaaaaagagcaggaagagctggaaaaccgcttgaatgagttaaagatccgtcccccgcgtgataagtccgctgataatatccggctggctgccagaatacagaaagcctgcgacatcatttccgatccggatatgggctatgagatgaaaggaaacgccttaagaagtgttgtaaagaaaattgtatacgataagcaggaaggaacggtaaaattcttttattacgtttccctgtgaccggacaaaagaccacgccgtttcttacacctgatcatatggtgctgcaatatggcccaccatactggctcataatgaacatagcaatcttgggattaggagtggtaatatttaccggatactgtaatctcttctcatacctccacattaaccgcacactccttcccaaggccatggatcttcaatccaggtccagtaattttcatccatcactccatcagccatcagaggaccacactgctcctcatatgcctgcattgcctgcatccgcatatttactacataatagtaatagttcaatgcatcctgatcgtctggatgggtgtcaagatacaaaaccacatcatccattgcaaaactggcttcatacacctgctttaacagcatatcgcaattaacattagaatccatcatcactggcacccccccataataaatggtttattcagatccgggaagatcgttccaacgctcatggccacatctagcgaatatacctgctgccactgctgccatggcacataagccattccaaccgggaactggtcgatgttttcggcaggagatgtctgagacggagcggaccagccggggcatgtaaccggggcagtgcatttgggcatttccggacatttgactgtcacggcttctttgaccttttccggacattttaccggcattgggcatggcggcatttcccggcattttgccggcattgggcatggcgatatgtcacggcattttgccggcattgggcatgcaggcctttccggacacttggttgatacggcttcctttaccttttccgggcatttaggaggcatggggcatggcgatatgtcacggcattttgccggcatcgggcataccggcatttccgggcatttcatcgtcaccgcctctttcaccttttccgggcattttggcggcatggggcatggcgatatgtcacggcattttgccggcatcgggcataccggcatttccgggcatttcatcgtcactgcctctttcaccttttccgggcattttggcggcatggggcatggcgatatgtcacggcattttgctggcattgggcataccggcatttccggacatctcatgcaaacgggagtggtttcagcttcactttttgtgtccgagcacttggtttttttaggcggcatccacgggcagggacctgcggacatcccctgttgtgtcatgagtatgggagatgccgcagtttctgcggattttgcaggacctgatccaaggggcatgtcgggacggatcactgtaccagggcttacagacatatcaagccccatggcagactcccagccggttggaccggtgccagtcatgcagccgggacaccattgcttcgtataacaatccataggatgtgtgactcctttcgctattgaaagattctaatatcaatctatgaaaggaatactctgttgtgcagggcctgcagaaatttttccgttaatttcaaaggaagatccgtggcatgggcattcccagcgcttatcgtaccggttccataccagacggcagcccaagtggggacaatttatggctcccggcatggctccggctgaaagtcccttcaccgactccaggccatgagaaaccagggtaccggctgctgccttcatatgatgtcttctgggagagaacactccgtcataaggtgttctttttcctgtgatctgggcgctcagtattttggctgcaaccatggacgaactcataccccattttccaaaacctgtggcaacataccagtccggctttaaggaagaaaacggtccgatgtaggggattccatctaatgtcatacaatcctgggccgtccatcttctgatctctctggcctccggaaacagatgctctcccgcccgtctcataatggaaaatggactttccttaggcgcttttccggttctgtggcttccgtatcccaaaagaagtttatcccccacattccgaaaggaatatcctctctcatcgattccaaggtacatgccgcggactgcttcaaccggttcaagctccatgacatagcttttttcctgatacatttttgcaaaataaaatcccggcacattgacaaagggataatgggatgcaaataccaccttttcagcctttacaacccctttgtccgtcaccacctcatgcccctgaaccttgataacccttgtccgctcaaaaaccgttatacctgcggaaatatctcttaaaaactccaggggattaaactgggcctgtcctttaaagcgcacagctccgtggacagaaaaaggaagtccggtctctctgacaaaggaggccggcagcccgagcctggcagcacactccgcctctcttgcaagcacctctgattcctgaaccgaatatagatatgcctccatcggttcataatggcattgtatggaatagcgtttaatcagctttccatactcctccaccgccagctggtttgcctttccgtacagccttgttgtttcctctccaaccgtccgcaccagcttgtcatagatcagattgtgctgggaggtaatttttgccgttgtaaatcccgtctgcccgcttcctatgcggtttgcttccaacaccaccacatgaagtccatgtctttgtaaatagaaggcagttagtattcctgccattccagctcctattaccacaacctctgtccgtttgttccctgtcaaagggttcctcccgggtattctggctgattctgtccagattgatttcattttttccacctcttgcctttatgcttaaaataccaaaaaatgtttaccttacccttattattcactctatttcaggattaatgcctattctttcccttccaattatttcttgatttccccctgcttttataatacaataaaatcaaacagccgataaacgggaggaaatccatatgaattggtttcgtaaaaaaacagctccgcctctgcagaccgggacaaaagtccaggttacaggagatatggtttcagagcgcaagccggaacgggatgcctgtttaaaacatttaagccaggtaatggactcaggagaacggggcgctgtgctaaagcttcacatagaaaatttcaaacggctgaaccaggtatttggttatgagtactgtgaaaacctcctggaacagatccttacatatttaaaagaagtgacaggaaaaaacgtctatcattatattggcgtggagtatatgatcatactggaccgctacacccagggacaggcattggagcttgcggaagaaatcaccggtaagtttgatcatgtctggaaggtcagcggaacagactgtttatgttccgcacaaatagggatctgttcctatccgggacatgcctcttcaccggaccaaatgttaaaatgtctggatttagccgttaataaagcagaggaaggcggtcccaaccaggcagttgtctttgacagcgccttgcagaagcagctgcagcggcaccagaccattgccctttatttaaagacagccctggaaaaggaagaggtggaggtccgttaccgccctacccttcatatggatacgggaatgtttgtccgggccgagctatacatgcgcatttttattaagggtcttggcttaatcggagccagtgagtttctacctgttgcagaggattccggccagatccgtgccattgaatactatgccctggaaaaggctgcccaatgtatctccggactgcttgaagctgactgtaaatttgaatccattgcccttcccatttctccagtcctttttttacaggaagatttccttgatgaggtaaagcggatcatggatacccatcacataccaaagggaaaacttgccctggaaattcaggaaagcgccttaaccatggcttatttaaacatcaatgtgatgcttcagcaattacaggaaatgggcgtggagatcatcctcaatgaatttggctccggctactccggaatctcctccatcctggagctgccggtggataccttaaagcttgagcgcctgttcgtctggcagcttgagaccaacccaaagtcccggtacatcattgaaggacttgtccggatggcaagagatcttgatataaccattattgccgaaggcgtggaaacagaaaaccaggtgaggatcctgacggaagccggctgcaattaccagcagggattttattattctcccaccctggaaaaggatactgtgttaaagattctcggaacttccttaacagattctcatcagctcctggcagaagaaaaggaaaaaatgagccgttaattttctcttaaacaaaaaagaaagcccaatggaaaggaggactcccatatggccaaatccgtatattaccagcgtcccgaagaccggtccttccagggcagaaaagtggagggactgttagaaaacgtcgaatattcccttaattccaatatccgcatctggcacaacattcaaacagaaggctatgccccccaccagcacagtgcattggaaattctcatacctgtggaacatgaatataccgttatcatcaacaaaaagtccttcaccttacagccgggcgacattctctttatcccccgtttttccatccatgagatacttccggcgtccagcggttcccgcttcatttatatgttcaacatggagccgctgtccagcttctatgattccgcctttttggatgtggtcctgttagaaccttgtcttatgaataaacaaaaccacagccggatttatgaacgcatttattccggtctcatggagatcaatgacatctattttccaagcgcgatcttctgggaatattctatatatgcgatcctgatcaacatcttgacaacaatcggcggagagtactatcatgcactctccgccaattcacaaacctctcaggaaaaacactatgaatattaccaaaagttcacaggccttttgtcctacattgacacccattacggtgagaatttgacattagagaaaatggccgcacacataggcttttccaaataccatttttcccgcctgtttaaagaacacaccaactctactttttatgactatttaagccgtaaacggattcaggccgctcaggaaatgctgctttctggtgaatcgattactgtaatcgcctttcaaaccggttttaacaatccggcttcctttagccggtgctttaagaagtatacaaaatacaatcctaccgagtttcgcagccaattcgccctctcgcctatcccttaacgccgcccaaagcaacaccggcaataatatagcgggaaagaagcagataaaccacaatcaggggaagcactgttaaagccagccccatataaacggaaccatattctgtcttataaatatctccccgaagcaggcttaccataataggcatggtatacttcttctgatccgtcaaaagcaccaaaggggtaaataagttgttccagctggacacaaagcagaaaatagcctgtgttgcaatggccggtttcataatcggcaaagcgatacggttaaatataaaaaactctccgcccccgtcaatgcgggcggcctgaatgatttccatggacaaagcgggcagcatatattgcctcataaagaacaccatagaaggagaggcaatggccggtaatatgagcatgaggaaattgttagtcatatgtatccggtaaaccatctggtaaaaaccgatcatggttatctgtgccggaatcatcataattgccataataaaactgaaaaatggtctgcggaatctccagttgtacaccaccagcccgtatgcggtcatgttggaaaaatacaccgcacaaagggttgcccccacggaaatgataagggaatttaaaaagccattggcaggattaaagcttttgcccagtaaaatggccaaattcttcatcatatatgtagagggcaaaagcgaaattgcatgctgctgaatctgtgtcgtagatcgggttgcattgatcaccataatgtaaaacggggcaatgcttaaaaccgcaagaaagacagataccacgtaaataatgattttcaataccaatgaactgtgctttttattcatgtgttttcctccgttccttctgcatttttctatattcccgttccctttgtctggtcagcttctccagttcggcttcatccttatccctcattgcaaaaaacagaactgcggatgcggcgcaaataattacgaacatgatcatacttgcggcggaagcccgattgtataagtaactgccgctaaatgcctgattgtaaataaatacgctggtggtcaaggtggaattgtccggtccgcccagtaaaaacagcttcggtatatcgaacatctgtaagccgccgatcaaactggttaccaatgtaaacagcaaaatggtctttaaattgggaagcgtaatatagaaaaaggtctgaacccggtttgccccgtccacttccgcggattcaaagatttcagggctgatccccagtacgccggaaatcaaaatgatcatggtgtaaccataccacatccagaactggataaaggatacacttccccttgccacggttttgttgacctgaaaattgattggctggtctgtaaatcctaaagtcatcaaaaggtcattgaccggtcccatagggtagccgatcagggcgttgaacagaatggcgatggtggctgcggtaataatgtttggcatataaaacagtaccttaaacagcccttttcctttgatgtggttcctgttatccgtaaaccacgccgttaaaaccagggccagaccaatctgaggaataaagttgcatatccatatgcccaaagtgttccgaaatgacttctggaacgagggatttgccaaaatgtttttaaagttcaaaaaggggtcatctgccagaaaatgaaactttaccatacccagtcccttgcagtccgtaaacccaatgacagctgtaaaaataatcggatacaaggaaaaaatcagaaaagcaagggtaaagggcagacaaaagatgtatccccatttcgcatatccagagcgctttcgtttcatatcagttcctccattcaacgcaatcgggcggacaagaagaaaaatcccccctcctgcccgctcaacattatttattcaacggtgatatccagattatctgctacctgctgtctgaaatccttaatcgcctgttctctgctcttgttccctgcggtgtattcccgcacctgatctctccaatacatgttaatggtttcatcgtactgtgtcaggttcgttccctttgcgaactggtttgccggaacaaatacgtcaaacatattctgtccgtttaagaagtcgatagaaccgtcggatttggccataaccgtaccggaagccacagcgtccttagtccccgcatcattcatggttccgtttgcccacatgtactgcaagccgttttcagaagaatccagggtgatccactggataatgtcaccaacagcctcttttacctcagaatccttatttgccaatacccatgtaccgccccagaagaagccaatgggagattcacaaaccgcccagtctccaaaggttccttctccgatcttttcgccgccggaattaggagccataacataattgatcagccacgcaggtccaaagaagcctaaaaccggctttgttccctggcccttcatatccgcaaaccaggcatcctgccaatccctggtatcgttatgaaatccttcatccatcaaccgcttggacagatccaaaaattcttcccgtttcgggtcaatggtcagcttaccgtccacgatccagccggtatcagagctgttctccactgcgtgccataaatctccgtctcctgatataatgccgtagcctttggcttttaaatccttggcagcattgaagaatgaatcccagctattagagcctcctcccaatttagcgccgatttccttcgggtcatcggttccccaggtatcctttgcaatggaacgacggtagataaaggcaccgcctgtggcctggtatcctaaagcaaccagcttgttatcaggattcgttccaatgtcaatggtatacttggcaatgtccgcttcttttacttctgcagccacgtcaattcccaggtcctcgtagggcgccgaatattgcctggcatctccctgcgtatatttaagaacaaatgcagcttccgcgcaaaacaagtcgggcgcatctttcccacctgccgccagtgcctgatccagtgccggctggtaagcaccatccgttgtggcaatgatggtaggattgatttcataatcaaagtccggatgcaattccttgtatttttcgatcattttaggaacttcatctgtaaaggaccagacattgattaccttttttccggcaggtccctcagcttctgctttttctgcagattcgctctttgctcccgtttccgcagattcattcttaactcccgtttctgcggatccgccttttgctccgctgttacaccccgataacattcccgccagcacacatgcgcctgccagcaataaaaaccgctttttcatgttcattcctcctccttttcataatcagcaaaaaactttatgtattgatttgtaaattcagtgtatcatacaagatgtcttttcgccctacaaatcttgctttttaatgtacagaaattgctttatgatataaaattattgctttagtttatggaggttttttttacataacataatttttttgtgtatttatatttattaaactctatttctataaatttctatatttattttgtctttaaaaatctggttttccatattcttatatagcaagaaatgcgctgagtttccatgaaacctaaaaatttgatataagaaagctgtttttaaaacaaaaaagcactttctgccaattatatggcggaaaatgcttttttaaagttttattgaatgattgctgcctgacaatttactgccggctgctgtacctccagggatttgttgtaaaaataacggatgacatccttacgggtaatgattccgataaaattcttttggtcatccacaaccggtacaaaattttggtttaatgccttatcaatcagatcttccatattggaatccgcgtacaccggacggttatctgaccttctgtcaagagcagctaccgttacctgttccgcttcctttaagctaagattgaatttgttcttgattccccaaagcatgtccccttcggttattgtccctacatatttaccccgtctgtttataacgggtactgcggagtatttgtgatactccattttctcaagcgcctggcgcagagattcatcctcaaaaatataagccacctcattcttaggtgttaaaaaaaacagtatgttcatagccacactccccgttgattctagtgaaggcaacaagccaaggccaagcgaacctgactttggcgactgcccactggttcagatactccgcagattgctgcgggtatttgacagatcggttatagtatagcagatgagtcttaatcacgtatgaacattttattatttttttataacattttcctgagatttcctatgagagcttactgcatataatccagaggatcaatggccttatcattaagggttaattcaaagaatacgttagatccttctatggaataatacttggtaggctcagccacatagcctaagacctgcccttctgtcacgtattcattttccactacctgcagctcttttaactgtccgcagatcgctgtatagttgttgcccatatttaagacaacgtagcttccaatttcttcattggagcctacttcctgcacctttgcattggcaggtgccacaaccggagtacttacatcaccctggatcacaagccctggattgcatttatactgatccagagttgggaaataaatggtggactccatgctgtagtccaaaatgacatttccgcgtataggccaggtcattctggtggcatcactaaaattaagcaccagagacgttgccgcgctcttgtctgtcccggcctttactgccggagcttttgtttcctgctctgcagtggctttattggaatcagccgcctgcaattcctcttccatattctgcgttgcacttgactctcctgcaactgccacttgtgtttcctggggatagattcttcaacaatcatattgctctgatccggcacttgcagataagggctctctcctccaccatttcctctttgaacggtaatgactcctgctgcagctactatagtcagcaggcctagaaccaacaggacaaggaatactttatccttgaacaattgacttattttctccttcacgtttatcacctcgataatattcttaccaagagtgaaagagttattcagaaattaaaacaatatttttataaaaataaggagaatttgttccgcagtccatccttcctctgctttgcatttggctccgtactgactcatgccgtatccatgcccgatcccctggcagatcacccggactcccccttcgtattcctcaaatccataggatgaggatggcagccccaggactcgctggatctcttctcccgtataaaccctggtgccgatctggatctgtcccacatatcctccctcttcccggagaatgatctggatgcttcctggaatctgatccgcatttacaggcacatcaccggagatctgattgatcttttccgcgaaatcctcttttttgtaagcagtcacattgagaaagccttccgcttccacatccctggggcaggaaaccggctgcagatagggatggttttcatctcctgtcctggtttttcctgtgctggcccggtgaaataagggatcaatgagcttaccgtcatacatcataaccattttagccgtagaccggaccgcattctccactgcctgatagctggcgacaaaggcttcgctcccccacagcttttccatctgctgctgctctaaatactccatatgaagctctgattccttcacttcattctgtccgttcatttttccgtaaatgtatgtcctggcaatgaccgcctgggccctgagagcttcccttccataatccgccggcatctgctttgccaccacgccgggcagatattcttccacatccatataagattcgccgtttttccggtccagaaggatcttctttccgctggtgacaataggaacgttttttctctcctcaatcttaccggtccaagccagagttattatatatggaaacaacagcgcaaggatacacgccataaccgctttttttatcattctgaatcaccgccctttccttactgaaacccttgttcaatatatgcaaaaaaacgccccggaatcacttccggagcgtttttacaatcttactcttcttccagctctacttttaccttttctaagtgccagatatctgctacatattcttcaattgtgcggtctgatgtaaacttgccgctgcaggcaacatttaagatggctgcctttgcccaccaggcttcatcccggtacgcctggtctacccggcgctgtgcctccgcataggaaggaaagtcctttaaaataaagtacgtatccgcacggtcactgctctgggtatttaataaggaattataaatatcgcggaacagttccgggttctgaggagagtaatagccgttgatcagctgcatcagcactctgcgtatctcatagttattattgaagatttccatgggattatatccgccttcattctcgtaacggatcacctcgtcggaagacataccaaagataaaggcattctccgctcccacttcctctacgatttccacattggctccatccatggttccaagagtcagggcaccgtttagcatgaatttcatatttccggtgccggaagcttctttgctggccgtggatatctgctcgctgacatctgcagccgcaaagatgatctcagcgttggataccttataatcctcaatgaaaaccaccttaattttgccgccgatgcttctgtcattgttgatgacatcggccaccgcattgatcagcttaatggtcagctttgcccgcttataaccggccgccgcctttgcaccgaacaaaaaggttctgggaaccatgtcaaggtttgggttatccttcagctgattgtacaaatacattacatggaggatgttcatcagctgccgcttatattcatggagccgttttacctgcacatcaaacatggatcttggatccacatcaatgccgttgtgctctttgatgtattttgcaaggcgcaccttgttctggtatttgatgtccatgaattcctgcctgcacctggggtcatccgcataaactgccagacggtggatgtgaggcaggctggtgatccagtcgctgccgatcttttttgtgacccagcccgccaaaagcggattaccgtgaagaaggaaccgcctctgggtgatgccgttggtcttgttgttgaatttatccggcatcatctggtaaaaatcccttaattcctgattctttaaaatctctgtgtgaagcctggcaacgccgtttaccgagaagcctcccacaatggccagattagccatgcggacctggccgtcataaacaatggacattttgcgcagcttttcctggttgcccggatacatctccatgatcttttgctggaatctgcggttgatctcttccacgatctggtagattcttggaagcagtctggagaacagctcaatgggccatttttccagggcttccgacatgatggtgtggttcgtataggcacaggtctttgtggtgatctcccatgcttcatcccagcttaagccgtagtcatcaagaaggatcctcataagctcagggaccgctacggttggatgggtgtcattcagctggaaaaccgtcttttcgtagaatgtatgtatgtcgtcatgcttttccatgtacttcatgaccgctctctggacactggcggaaatgaagaagtactgctgtttcagacgaagctcttttcctgcatagtggttatcgttggggtaaaggacctctacaatggttttagccagattttcctgttccacggccttttgataatcgcccctgtcaaaggaatccaggctgaaggtattgatggcctgggcatcccagatccttaaagtgttcaccacattgtttccgtatccaacgatgggcatgtcatagggaacagccaggacagactggtatccctcctggacaaagcgttcctttccgtcttcccagacagtattcacatagcccccgaattttacctcagtggcatattctcctctgcgaagctcaaaaggatagccgttcttcagccagtcatcaggaatttccacctgatatccgccttctattttctgcttgaacatgccataacggtaacggatgccgcagccataggccggatatccaagggttgccagggaatccaggaagcaggccgcaagacggcccagccccccgtttccaagagcaggatccggctcctggtcctcaatgacatttaaatcaaaacccagctcttccagaacttcctttacctcctgctgggccataaagcttatgatgttgttgccaagagcacggcccatgaggaattccattgacagataatacaaggtctttacatcctgcttttcgtactccttatgggttgcgatccattcgtctatgaccacatcctttaccgcataggccaccgcctggtacatctgctccggagtagcctcgtcaaccgtcttgcggaacacatttttcatattaaacagaacactttttttaaaggtttccttatcaaatcccatactcattctacaaaacctcctaaccgtttactggaacttttccacacccagggttacattttcgccgttaatgttccattctttcacataaccggccagcgtttcaaggatgatgttttccgcaagtacctcgctctttacttcttcctcgtgaagctttaatataccggcaattttttcattgcccttgctgtataccacaatgtgatccgtcacctcaaacccagcttccttacgcatggtctggatcttgctgatcagctcacgcacaaagccctctgccaaaagctggggtgtcagattggtatctaaaacaacggtgatggtattgtctccctcagttacataaccttctgtctgagccgtgtcaatgagaaggtcttccttggtgagcacaacttcggttccgccaaatgagaaggtaagggcacctgtttcatttaaggtgtccatggcctcattgccgctcacctctgaaagagcctttttaatgtctcccagctgcttgccgtatttcggtccaacggtctttaactgaggtttaaagctgtaggatgtgaaatctcttacatcatcagtaaataccaccttttttacgttcagctcttcctcaatgatctcctgataaaatacaggaaggacgtgaggtgcttttacgaacatctggccgataggctggcggttttttaaattagccgtatttctggcagcccggcccatgactacgatttttaatacttcatccatgtcgatttccagctgcctgtcaatataggctttgtttgactccggataatcgcataagtggatgctctccggcgcagactgatccacgctgcagaccatgttctgatagatctcttccgtcatgaacggaatgaggggagccgcggtcttgcttactgtgacaagggctgtataaagggtcatataagcgttgatcttatcctgctccattccctttgcccagaagcgttccctgcttctgcggacataccagttgctcatatcgtcaacaaaatcctgaagcgctcttgccgcttccggaatctgatagccggaaaggcaggtatccacagtcccaaccagggtgttcagcttggaaagaagccatttgtccatgacgggaagcttatcatattccagactgtattttgtggggtcaaattcatcaatattcgcataaagcacaaagaatgcataggtattccacagggtgcccataaatttgcgctgtccttccataaccgctttcccgtggaaacggtttggcagccatggcgcgctgttcacatagaagtaccagcggatggcatcggcaccgtaggtttcaagcgcgtcaaaaggatctaccgcatttcccttggatttactcatcttttgcccgttctcatcctggacatgccccagaacaattacatttttatatggcgccttgttgaaaatcagagtggagatggcaaggagggagtagaaccagcctcttgtctggtccacagcctcggaaataaagtcagccgggaattgctgctcaaacagctctttgttttcaaaaggataatgatgctgtgcaaatggcatggaaccggaatcaaaccagcagtcaatcacctccggcactctcttcatctgctttccgcatttttcacaggtaatggtcacctcgtcaatatatgggcggtgaagctcaatgtctgccgggcagttgggtgacatggcctttaattcctcaatgcttccgatggagtgctgatgaccgcactggcattcccacacatttagaggcgtgccccagtaacggtttctgctgattccccagtcctggacattttccagccagtcaccgaaacgtccttttccaatgctttccgggatccagttgatggtattgttgttgcggatcagatcttcctttacggacgtcatcttgataaaccaggattctcttgcatagtagatgagcggggtgtcgcatctccagcagtggggatagctgtgctcaaatataggtgctgagaataacagccctctctcctttaaatccgttaaaatcattggatctgcttttttgcagaaaatgcctgcccacttggtttcctccgtcatctcaccggccgcattgaccagctgtacaaagggaagatcatattttctgcccaccttggaatcatcctcaccaaaggcaggagcaatgtgtaccacgccggtaccgtcagtcagggtgacataatggtcacatgtcacgtaatgtgcttttttatttggttttacaaagtcaaataaaggctcgtattctttatactccagatcctttccctgatacctttctaaaaccgtgtactccccttccagaaccttttcacagagagcttctgccagataataggtatagtctccgttctgtactttcacataggtctcatccggattcacacaaaggcccacgttggaaggaagagtccagggagttgtggtccatgccagaatataggcttcctctccctttaccttaaaccggacaatggcggaatgttcttttacatccttatacccctgggccacctcatggctggataagggagttccgcaccgggggcagtaaggaacgatcttaaagcctttgtacaaaaggcctctttcccagatctgctttaatgcccaccactcggattcaataaaatcattttcgtaggtaacatatgggtcatccatatcagcccaaaagccaacggtttttgagaaatcttcccacatgcctttgtatttccaaacactttccttgcaatacttgataaatggctccaggccatactcttcgatctgttccttgccgtcaaggcccagcatcttttccacttccagctccaccggcagtccgtgggtatcccagcctgctttacgcggaacgtcatagcccttcatggtacggtatcttgggatcatatccttgatgaccctggtcaatacgtgcccgatatggggtttcccattggcagtgggcggaccgtcataaaacgtgtaggtttctgcttccttgcggttttccatgctctttttgaaaatctcatggtcttcccagaacttttcaacttctttttctcgtgcgacaaaattcaagtctgtagggacttttttgtacatcttttgcgacctccatttctgcatatataaaaaaagccctcatcccgtaatcaggacgaaagcctcactatatctccgttacaccacctattaccgcataccagcatatgctttcctttaacgcagaaactacgtcctgacctactgccaaggctttcggccggaaactccggagtgatattcaaacccacgctactttcgccaggcttccaccctccccggctctctttggatttcccatggtcctactgtctccatcaaagtctttcttcttattatgatatggtacggtatatttccgtattttataattatatggatttggaaaagaaatgtcaaggctaatttgtttttccttccgtaaggcacaaaggagaacgggtaccgaatcatattcatgaaattcgatacccgttctacacgctttcatccattagttcttaattacctctctcgtttcgttttttacttcacgttttctggatgctctatatgaattttttcccgttacctttcgcctaaaaccatctactaatctgaaatctctgcatcgttgttttcattctactatattgttatccagctaccgaacaaaaattcaatccggacgaatcaaaattacccatcagatgaatatttctctgcagttataacgaactataggcatataagagattggtagatctttattccggcttcatccatgctttcgcatttatccatcgcccttttcggttttctgccaaggtctaacggttttgcctcttgcctgaatttgcctataacctgattcaggcgaaacttatgttttcggtggaatcaacctccttttctctgccatcctataaatgaaataggaagatcggattagatatttttttcttttgttatggctttattatatactatcccgccctgatttgcaagtctttttttataaaaataattaattaattattaattttcaaattgtattgtattatttagattatttaattattttcgaatatttatgcgatatttatgccccaattaagattgttacttttttgtcaattccattgtttttttgtaaacttatggtataatgtgcgaaaaggtttagtaaaaggaaaaaaaaggagaacagctatgagccagcgcaatttaaccttattaacagatctttatgaattgaccatgatgcagggatattttaaagagaaaaacgccaacgagaccgtaatattcgatgttttctaccgcagcaatccgggcggcaacgggtacgcgatctgcgcaggcttggaacaggtcattgaatacgtaaatgagcttcatttcagccaggaggatgtggattatttacggtctaccggtctgtttgaagaagactttctggaatatctcaaccattttaaattttccggcgacatctacgccatcccggagggcacggtcatattccctcgcgaacccttagtaaaagtcattgctcccattatggaagcccagctgatcgaaaccgctctgctcaccatcatcaaccaccagagcctgatcgccacgaaaacagccagagtcgtatacgctgccgcaggagacggagttatggaattcggcttacgccgcgctcagggacctgatgccggaatttacggtgccagggctgccatgatcgcaggctgtatcggtacctccaatgtgctggcagggaaaatgttccatgttccggtgagaggaacccatgcccacagctggatcatgagctttcccgacgagctgagtgcgttccgcagctatgcaaagctatatcccaccgcatgcatccttctggtggacacctatgatacgttaaaatccggcgttcccaatgccatcaaggtatttaaggaaatgcggcaggcaggaattcctcttaccaactatgggatccgtctggacagcggagacctggcatacctttccaaaaaggccaagaaaatgcttgatgaagccggattttcagatgcagtgatctctgcctccaatgaccttgacgagactttgatcaacagcttaaagatccagggagccaccattaattcctggggcgtgggaaccaatctgatcacttccaaggactgcccttcctttggcggcgtctataagctggcggctgtcatggataaaaaaaccggccagtttgtaccaaagatcaagctttctgaaaacgcggagaagatcaccaatccgggcaacaagattattaagcgaatttacagccgggaaacgggcaagatcattgcagatttaatctgcttggaaggagaggtctttaaggaaaaccattccctcctcctcttcgatcccattgaaacatggaaaaagacccatctggcacctaacagctataccatgagggatcttcttgttcaaatatttaaaggcggaaaatgcatttatgagacacctgccgttatggatatccagtcctactgcaaaaaggagcttgataccctttgggaggagtcccgccgtctggtgaatccccatgaagtccacgttgacttatcaaatgagctttggcatatgaagaaccagctgctggacagctaccatttcagagactgatccatggagcaagtccattgttcacactctggtcataatctttttacagcatggtcaaattttcttcatatttaaccgatatactaaaaacatcagaaaaagatgttgccaacatactttgagataaaaatttttttcataattgccggtattccttcgagggataccggctcctccctttttcagggcttcttttcagcatttccttttacatctgctttctcaccaccgagtaatcatccccgaatttaaaatgtggacagctttgaaacgaattgcttaagaagcgtatcatctcatcctcatccagattgatctcacattcataacattcgtattcttcattataatcatagtgtatacaatattcacagcttgctttccgttccatttaaagcgctcctttgcttttattccttctataactgatcaggcccattgcctttttaagcagctttcctatggttccgtcaatgatccaggcggctgccagggaaatgagaaacgtcaaagctgtctcacagaggatcttgggcacataataatgtcttatgaaagtcttttccaccagccctctggccacctgccccaaaaccaggtaatggatgaggtagatggaataactgtaacggcttatatgacctgcaagctttgcaaggaatggcattttaatatccccgaaatgctcaaagaacaggaacacagccgcagcaattgccaccattgtgggagccaagtcgtggatcccgggtgtaaaggatggggtgaggcatttttgaaccattgtgatgccaaaaccggcaatgccgagaatcccaaaggggagatacctgctgctgccgtacaggcgctttaatgcataacccaggacaaaatacagaaaccagcccttaaatatcatatattgaaggctccctcctaaatccaggccaaaggccggaagataggtacagattccctggacgatcaccataagtgcaagaaggagctttaaatccttatcgctcattgccttcatcatccgggccagaaagggtgcacaaaggtaaagcgccatgatcacatacatgaaccacagatggggcgtcatgggaatggttcccataaaaagcccttttccaaaagcccctaagtgttcctgccacctaaggggttcctgccttaaataaatttcataataccagtaatagatcccgctgtaatatgcaaaagggacaaaaattgtctgaaaccggctgcggtaaaatcccggaatatcctctgtccctgattctaaaaggaagagtccgctcagcataaaataaatccctacaaatgataaaagcaccggcaatagggccgccgaaaacagccattgcctgtaatttaaggtttccgccggaaccgcatgaatcatgataatggcaaagaccgcaagagtccttaaataatcgtatttcacttcccgctttttaagccccatgtctctcctcccgcttcctctgaacttagaaaagtatagcatatttaatccgattttgacaaattttttatttcatcaaaaaaagtgtagacaaatggaaaatcctatggtattataatgaagctgtcagagatgacacacaagaacggcctattggtcaagcggtcaagacgccgccctctcacggcggaaacccgagttcgattctcggataggtcataaaacgacactataaaatcttgtatttacaggagtttatggtgtttttgtttcataagaaggtgcttcctatgatataaaatccctctggagaataccctgggatttgtctctcaccttggggatcatcctgaggcaggcttttgttcttaatcaggctttacacaattgaatgttattatttaagccacagaaacgccggacagatgatctatccggcgtttcttttgcagataaaggtccggtctgcatgtccgccctaccttttatgaaagtaaatatgcaggacaggtctttttacagtttgatttaaaaaacagtttataaaagctagtcaaacggatatccgcaatccgcttcgctgcttaattcggttaaaactgaatgatcacaggcttatccattaacgatgagatcgttgctgtggcatcctcgagataaaaaacctcggtattgccgtcatcggccgcgtacatttttagcagtgaggggtaggtatccagcatatgctgccttgcttcaatccggtcatcctcaatagccaaagcttcaatgcggatccatttaccatcggccataccgcagatttcaattttcggattggcatgaatctgttttgatacatttttgatcttaccggtttgaatgtagagcttgtcttcaaaaatatccaccgtaccaaatggccggactcttggctggtcgccatccattgttgcaatataatatgtctcacacttttttaaaaaatcatatacttctttcattggcttatcctccatgtcttaagggattgactgctgtttttctttgctatataatagtacgacaattagatgtgctttacaagtaggcatatgattgtgacatagtcataaaaatatgattattggagaaggagcggatttctgatgtctgataaatttgatgcaaacaaattatgtccggtaactgtaacccagaatttattgatgggtaaatggaaattaactattttatggatcgtcagccgcagaaccaggcggtttggtgaactgcaaaagctcatacctgatgtgtcccgcggggtcttggcacagcagttaaaggaactggaaagagataacctcattcatagagaagtttataaggaagtgcctccaagggtagagtactctataacgaaaatcggtgagagctttattcctataatgactcaaattatggagtggggcgtatcatatattaataagacaaccacctgtaatgtggatgtctgcatcgccaacaatttcccgtgttccaagtgcagcgaaatgttaaatcttgaaaagccggccattgagggacttgaataaaaaaccatgttaattatataacacagagatggcacggagttaatccgtgccattgatttagataaccgctttcatcctgtataaagaagagacaggaaatcacctttttaagtttttctaatgatttttatggagacaacacaaacatcccttatgagaagaacagcttccatacggcaattaatatagaaaagacagcgatccccttctttaagagattctggtttatcctgaccgcatttctgcttccaaaggtaactcccataccgtgaaataccagcgctgctgccatcaccggcaagagggatttcatattgcactgcatcatgtatccaatacaggcaggaatccctataaacactgagttaaacagggcgacacccactgccgttctgatgccgatacccaggaccaccaggagaggcatgaccagaaccggacctcctgcaccggaaagggcgcagatcatgcctgtcacaaaccccaggaccagggttgctgccaggtggtctgatataacatagcctttgttcccttcctcttccgtccggtctttcctgagaagaatagaaattcctgataaaagaaccaccacatacaaaagaattttcaccatggattccggtatgattaagttcagttttacaccaataactgctccaagaagactccccaggcttaaacggatcccaaagggaatatccaggttgcccgctcttttgtagtttactgagccaagagctcctgatacgataaaagctgcaaagctgagagccagcccctccgttacacccatcgacaaaggcccggtatatacaatgggaagaagaaatcccgccactcccgtaagtcctacaaatgctcctaccaccaggttggcagccgcagcaatcagccaaaataccatgatccaatatatcctccttgtttcttcgtaatcattacttattcaccgattccatatatttccctgactcatacaaaatcttttcctcatccatggacagcacttccctgtccttcattattagcctgccgcctactatcatatccgctacatctccggcgttgacgcattccagcaatgtatgaagcttattgcctgtaggacaaaggtggggctgatccatgtttatgcttatgatatctgctttgtatccggactccagccgtcccaggctgtcttcctcgtaaagagctgctgcgccgccttccagaaccatccggaaaatagtttctgccggcattatctttggattgctgccgggcacaccatgataaatgttcataagagaacggaatatcttcatctcattccaaaggcttaagccgccatgggccgcaccatccgtacccatgcctattgaaattcccatatccagaagctggggcgtatccggtactgcttttccgcagttgctgaaaggacagtggcacacctttactcctctctcctttatgagagccttttcttcatcagaaagaatcaggctgtgggcgcccaggaagttgctgtcaagcacctgcattttctcaaggtattcgtaaggccgcattccttcgcgggccatgattccatttatttcgcccatatactcattcatgtgagcctgaagcatagttccccgctccttggcatgttctgactccagttccaccaaacggctggtgcaggaatttaaagcccgcagagagtaatatacctttaagctcccttttccatgaaatctgtcatacagggagtccgtacgctttaccgcttcctttgcgctcattgaaatggattccggaaggccctcctcatccattgttgagtaggaaagagcgcctcttaacccgctttcagcatacacagctgctgcatcttccataaagtaacttcctgcatctataaatcctgtggtaccgctttttatcatttccagagccgcagcctgggcgctgagccgcatcttttccgaagtcagggtgctctcaaaaggaagcatgatcctggtccagataattggttttgcatccagcacaaaccccttcagcagctgctgtcccgtatgtacatggctgtcaataagaccgggcatgaaaagctttccctttccattaatggtctcagaggcccggtattttttccacagacctgcccctgcctcttcgatccgtccggcatttatgacgatatccgtatgctcccgcaatgtttctgcactgattaacacactgctgtcctttattaataaatcgcatgtccgcatatttttatctccttaatgttgctaaattacgcctgccagtgacagcagcatctgatcccagaggcaggaacctaagaaggttccggtcataacaaaaattcctacaatcagtatcttccagccctggctgacaaaagtctttaactgatcgctgatcgccaggcctgcgaaagcacccaccatagtaaagggagctgtaaaattaatattggaggctgcctggatcacaaaatccctgacaggagaaactggggaggctgacagcagtccgattatggaacagtaagccactatgggaagcttaaggggaagaacctttgttaaaaatactgcaatcatggaaatcacaataagtactgttaagcccggaagggatgtgctaaatcctgttccatacccgataaaattggccagccctgtgccgcaggcagcaattacaaataagataagccattctatgtatctcatactgtctcctctttctccttattcttaagggtgattttctccagcttcggctctaagtacctataaagcctgtccgtcatgggaatagcaataaacatggtgatatacattccggtaattccagctatggtctctcccacactggccatagcagaaatggtatcagcccattcaggataaatagcgcacaagctggcactggagcttgccatcatgatgcctgcgcccacgccggaggccaatcccaatgcctggggatggaacaggcccgtcatacctaccacagaagccataagcccgaaatatattgtccccaccatacctcctacgatatagatggaaaggctccccctggcctcagctgaatcagggccgtaaatattattgatcagtgccatgtggtattccctgttaatagaatgacaggctcctatggcctctctcttcattcccagaagaattgcaaccggcagcgccagcaaaggccctaacaagttgccgaatccatggagcagaagcaccggaccggactgtaagatggtgtcgatgttggctcctgccgtgatccccagcttggcaataaacggacagatgcccaccacaaccagcctggaggccgccttaacatgcttgctgtccgcgatcttaagcacttgaggcccgcttaacacgcctaaaataattgcataaaaaatcggaaacagaataaacattccttttccaacagggatcttaatctgccctatattatccgcaataaggataaagacgaatgccagggcaaatatcttccactccaccgcaaaccgttccttcagggaaccatacacaaaagtttcttttttgctgccgctcataagagcccctccttcccagccggcatctttattccctgccggctgttacaatctccttgtgttgagtattttatacaaaacatcgtcttaaaaaaaggacaaatgagcacttcccacaaaaaatcccgattgattttatcttttagataatggtatactggatgcaaaacaaaagaattgagaggatatgaatgacactgactgagctggaaaaccgggttcccgctttaagggaatatacaaaaaatatgccccatgatatacgaaaccgctgcaccgtgcggacccatgccgcaggttccatcatacaccagaaggatatggagctgaactattttggaattgtagcggcaggtgaaaatcgggtcatcaacgaatttgaaaatggaaatgtctatatgatcgagggtaataaggccatagattttatcggagaagttaccatactcgcctgtatggaacgtacctccgtgaccattgaagctgtgacggataacgtggttgcctatatcagccggaaggatgcggagcgctggctttcggaggatatcaatatcctgcgcctggcctccaaacacaccgcattcaagttgtaccgctcctcttacaccaacggtgcaaagctgttttaccctccagcctatcttctgttagactatatagtgcgtttcggaaggcagaatggcatggataataaaaaaccttcggaaaacctgaccatcaaccggacgcgccagcttctccaggaagagatcggagtcaatgtaaaaacgctcaaccgcactatctatcagctgaaacaggaaggattctttcatgtctgtaaaggcaaaatttcattttccagggaacagtatgaggctgctgtcatatggctgaatgcagccaaggataaataatgggggccatgttatttcacgtaaggaatatctgccctgggtttttctaatggaaaaccaggttttttcgtattttttctctttatttgtcagaggatgccaccgtaagctgccagacagtccttccattctgccaaagttgggcatacactgtccggcatttccggtatctggcaaacaccagggctgcctcccgctcatcggcgtataccttccaatagccggtgcatttgctgttctttcccccattttggataaaccccaccacatcttccaggggataaccgagaaaaacgccgatctcatggggaaaatctccttcctggttcagccgttcctttagcctgttaagtgcagcctccacctccgtttgctcatagccgtaggcttttaggaacctgcccacttccggcctgcttaaatccgcctggaggcgggatttccggcagacatagataagcgccttattcctgcgcctgcacaacaccagcagggatattcctttcccttccagctggctgtttaagcctgccagctggtcttccagttcctcttccgaggaaaagggatgattaaacaagcttgccgttttgagagaggccagtgtgggagaacaatattcaattaaatttttttcaagcagcatatccgcacctccgcctgcgttcctgtttcatggaaattgctttcgcaggaattatcctgttatgaatattataagcagcatcagcttggatacttttccaatttttgtcagaatttctttatttctttcatactttctttataacctggtcaaaattccttcacatttatcctgtatgataatattataaacataagagatcaagagaaagcggtcagagcgcttacatacatgtttttactaagtcggcagagttgccctgaaaggcttctttgccggctcaacctaaaaagtaaaagccggaattactgacactttttccaaagcttgaatgaacgatagaataaaggaccgctgcaccataggtaattacctatggtgcagcggtcctttttctttagaatgggagttgaaaggaaaaacctgtatcaacccccttttcttaaatctatttctcagattcaacaatcccgagagaagcatctccctttctcgccttttccatgagaagggaagccattttctgaaaatttcctccggaagaagaggctccgcttacagtatcgattcctttgtcgctttgggccgcaaggaagctggcggcataagtgcgggtatagcggttggggtaggtccccttttggtcgttcatattgcgcatatagggaatatcccaggatttgatgaatccgcttgcatttctggcattgtattcaaccgtaacaatcttgccgttgctgacgcggatggtgacaaattccttccagcctttgctgtaatccgacatttccaccgtataaaagccatcttccatcctgctttccttttttttgcagccgcttacagataatacgacaagaaggaacaggaaaatcattaaaaagcgttttcttttattcattgtgcatctctcccttcggaattggtacgaagacggaaacgtccggacatttcttcaaggctttgggcctgctgtgctaaatccccgcttaaggaagccacatccctgcttgattcaaggttctgtcgggccagctgggagatccgggagatgtctgaggacgcattttccaggctggacttttcatttcctacaagccttgccaagtcctccgtgatctcataggtctgcctggatatatccgtcagctcatttaagaagctggcggtaagattggcatactgggatccctcttcaaccgctctttgggaatttccgatcatttcagcggtacgcttggaagattccgcacttttttcagcaaggtcacggatttcatttgccactacggcaaaacctttcccggcctcgcctgcatgggcggcttccacacttgcgttaagggctagaatgtttgtctggaaggctatttcctcaaggaattttgtgatctttgttatttcagacgcattgtggctgatattcttcatggcctgaagggtgttttccatgtgttcatcacccatggacagccttttcatggactgctccataagctcacgggcatttcttgcatggtcgtccacaatgacgatgtctttggatatggagtccgtctcttccaaaagcctgtcaatggctgctgactgatggccggaggactcattcataaagcgggcgctttgggatacaccctgggctgcacggttcaaggtctcagccgattgctgcaagtcgttgatcagctggtttaagaaatcggttatgttttgaatggagtccttcataatcacaaagtctccagcaaactggttgctgacgctgacgtctaaatttccggcggaaagctgttccagggcattttgaagctgggaaatatatccgctcaccttttcaatggtatcctttaaagaattggagagggtctgggcctcgtcatttgtcatcatcacttccaccggacttgtcaaatctccctgggccagcttctgtatcctttctgttacgcttcccaaagactttgagatttttcctgcaaagcgggcgatgaacagaactgcaagaagggtaagggttatgatgatgcctatattgaccataacagctgactttacgatgcccgtaaaatctgatttgggagttatgatggccaaataccagttagcacctcgtacaggcgcataaaccaccagggtgtcttttccatccatggacacagaagccgatccgatcctccctgttttcattgcatcaaaaacttccagaagctttgcattatttttataaagagaatatacattctctccgctcttgatgatgccggtatcaggataagccactacctggccgcttccattcataacaaatgcatggccgctgtagccgatatgtatactgctgatcacgtcgtcaagcatgtcatacttgtagcttcccaccagataataggtgttctgcttttctgtggtaatgggcattcccacggatacttcaagtccattttctcccacaaaggtatcccctatgacaaggttctgggtctcctgcatcatggaaaataaatctcccccggaaatatcggcaggactgtttccgttgccggtgtagagcttgccatcctgagtatagagagccagccagacaaactctatgcctgatgcggccttattaaggacctggcgcttttcttccatggtcgcttcctctgatgacagttcctgattttccccgatcataaatatgcggtctgccatgatatgcagactgctttcaacactttttgaagcagttttagcaaatggaataagagtttccatcaatgtggcattggtcaaagacattgcagaaaccgacaatacaatagttgtaaccgcagaaataattatgatgacaattaatgtgtttaagatgattttctgccgaattccttttaaattcatatatcctcctttgtattgttacataaataatttaatacttataaaataatataaccgatttcgaataaaaaacaatagctttatggaaataaaagagattattggtaaaaaatgtcatattggttttagaattttttaaatgagacacaaaaaagtctgcttaataaccatggaccagtcattgatgagccccttccccctgtcagtcactttctgtttctggggacatactataaataagaaatacgtatttctacaacatgttaaaaggggcatccttatggctaattataaaccaatagcaaaaacgatttcatctgcttctgcaatttcaggagtattggttcctgctgatctttccacgacaagctgggggttacttttagtaagaggttccgcattattcagcaatacgatcctgcgcagcggcgcagtggccgtatgggaaagtacaaatcctaccaccgctgctccaaaccgtcaaacatttacagatgcaaatgccgtatatggcattacctgcagagccggagtaaacttgatattaaagttctatgctaactaacttttaaacagggcgcctcaaaggtcagaatcctacatcacgctcaccaaacaccaacgggcgaaagctaatataacgatatctggcatgtatgggatttgaaaaggaacctttgaggcgccttttcttcaataaacattatttatcacaaaggagggggaggactattgccaaaagtaactttcacaggctgtcagatcatttgttccagaatcgtgacagcagatattaccctgtcaaataactcgtatctattgatcacgggaaccgtatacagccccaccggaaagcctttgccaaacgctgccgttgaaatacgctttgtggatgattcccggattccagcagaagaaaaatgcttaggcgtgacctttacgcttcatgatggttcttacggaatatcacttcccagaattggtgaaaagaaatataaattgattgcttattcgcccgtataaacgggaacaaagtataaccaatgaacagggaggttgtaatgaagaagtataaaacattggatggctaccacgtctatgggataaaaaaggataaaaaacgaatctttttggctgaccggatcaattacggaaaggagataaaaaaactgctggataccttagatgacttaaaatttgactccctgattttcctatttggaattgatacgggagcatacattcctcttatgaaaaaattgctgtgtgaaagaaacagagtgattatttttgaaccaaaccctggaatccgaaaaaaattcggttctaaattaggggacaatatcattcttgttccctttgatgaaaaccaggtgaaacaaatttttgacagtatgatccactttaaaaatatcaataacatttactttcacgcattcggcaactaccgcagcgtttatgaggaagaatacggccgattgatcgaactgcttgattggaccatcatcaatgcagcttcccaggtggatcttgcaaagcgctttaaaaaagttttcatccagaacatgattgccaatatgaaagcattggaccggtccactcctatccaccgctgcaggctgtctaacttaaacgtgccggccctggtagtatccggaggcccctctctggattccaacatcaaggaaatgctggctcataaggatcagcttgaccggtattttatcattaccggaagcaggaccgtcgaagccttgacgaaaaacgggattgttcctgatatgatcgtgtccgtggatccggttgatgctaactttgatatgatgaagaactgcttaaatctggaggcgcctcttgcgttttatgaatacagcaacaggtatttagtgagagattataaaggagataaagtcttcatctctctcctgttttcccagacagtagagggctttgaaaattatcaggcagtgttttgcggaggttccgttgcccatgcctgcattgacattgcaaacatgacgggctgctctcccatcatattcctgggtcaggattttgcccatacttaccacaagcaccacgcggacagtgcggtctttgattatgataaaagcctgacatacggtgccacaacccttgtaaaggatgtttacggaaatcccgtggggaccaccgttaccctggatcattaccggagaaggctggaacactacattaccatttttaaggaccagaaacggatccggtttattaactgttcctatggagcggaaataaaaggtgcgccacataaggagctttcggaagtgtttaaggaagaagcaacaggcagacaaaaaaagaagttcattccaagccgtgaagtccatatggacagcaaagaaaccatagattctctccttcactttctggaggaatacaggataaaggcaagccaatgcctggaattatgcgaaatcatacgttccgaaaaccatacaaaatctcttttaaagattgatgaaagagatattgatttacagagaatcctgtatatcttaaaggttgtgactgactttgaaaatgatgtaaataccaaatatctgggaggatatttcagcgaatttgtttttgaaatgaaggaaaaaacatttcatatgtctgcaaaggattataaaaagctgacctctgatctgcagcatcaggccaggtcttttcaaatatattttaatagaatgaaagaaatgctggaggaagtaaacgaaaccattttagagaccgtaacagaattctattaaccgcatatagtttagtaaaaaaatggaaaaagaggatcgagctatggaagatgagagcaaaaataaagaaatcaatgataccaaatataaagaagtaaaaatcaataagatgatcatcaacgggaaggaacaggcgggaaacattatcaatgctgaggataccaatgggaaacaggaattaaacgtgaccgtatatacccgcagcatgaccgaggccgcaaaaggcggagggggcataataaattttatgaactgcttcaaaaagtcttctttaagaataaacggagctaggctccagtcccgcccggaatatcactttcacatccagctggaaaagcagaactttcagatcatcaagggaaccatatacggtcaggaccagaagccctgcaggggggctgtgatccgtatcgcccaaatcgactgccaggacggcaccaggcagctgctgggttataccgtggcagatgaaaacgggtattatttattttccattaaggcaaagtctgataagaagtatgaattggctgtttatgctcctcttcttttcttgggaaaggagggactccattgagcggttatacggaaattattttgtcaccaaagcattttaagaacagtgacatgataaagaccactattatcatggaaaaatctgaccaggtcttgttgagaggcacgatttttaattcacgccaggaggtcatagaaggagctgttgtccgggtcatcaaaataacccaggaaaaccagcgggtaaataagggttatgtgatcaccaacgggtccggagaatttgccattgccgtggaaaaagacaggtacgccaattatcagctggatatttacgaaccacttataaccacttaggcggggttgcacattatggaacagatcaatcatgaataccatatggaaggtatattaattaagggaagggtccgttataaggattcttgtccggtcataggcgctgttgtaattttagaaaagctcagccctgtttatgatgaagaattacaggaaaacggacagataggaacctaccttgagcatacgctcaccaatgaatggggagaattctgcttttctatctcagataagacgagcagctacaaaataaaggtttttgataaccatcacaagtaagggaggaaacatgaaaaaggttctggttacaggagcagatggatttataggcagccacttaacggaaagacttgttgaacagggatatgaagtaagagcgtttaccttttataattcctttaatacctggggctggctggactctcttcctcaaggaataaagaaagaaattgaaatacaggccggggacatccgggatcccaacggcgtaagaaccgccatgactggaatggaatccgtctttcatctggctgcactgatcgccatccccttcagctatcactctcctgattcctatgtggataccaacatcaaggggacgctaaatgttctccaggccgcaagaagccttggcacggataaagtgctcatcacctccacttccgaggtttacggcagcgccagatacgtccctattgacgaagcccatccctttcagggacaatcgccctattctgccacaaagatcggagcagacaggctggcggaatctttttacagaagcttttcccttccggtggccattgtccggccttttaatacttacggaccgagacagtctgcaagagctgtgataccggccatcatcagccagctgttagcgggagccggggaaatacgccttggcagcctgacccccaccagggattttaattatgtaaaagatacggtaaacggatttattgaaatagaaaagtcagaaaagaccattggggaagagatcaacattgccagccagaaagaaatctccataggtgaacttgcattggagctgatcaatcagatcgacccaaaagccagtatcatctgtgaatctcaaaggctgcgccctgaaaaaagtgaagtaaacaggcttttgggatccaatcagaagttaaaagaccttaccggctggaaccaggaatacactctttcccttggcctgaaagaaaccatcagctggatggagaaaaacctggataagtacaaggccggaatctataacctatagaacgaaatgagggggaggaaagaatatgatccctttatccgttcccaatctaaaagggaacgaaaaaaaatatatcttggatgctcttgaaagcggctggatttcctccgcaggcacctatgtagcaaagtttgaacggaacatggcctcttatttaaatgtatccggcgcagctgccgttcaaagcggaactgccgccatccatttggccctgctcttatccggcgtaaagccggggcaggaagtgatcgttcccacccttacctttattgcttccgtcaaccctgcggtttacgcaggagctgtcccggtctttatggattgtgacgattctctgaatatagactgtgacaagctggaagattttttgaaaaaggaatgcctcatgacctcttccgggccggtaaacaagcgtaccagccgtcacattcaggcggttgtggccgtccacatctttggcaacatggcggatatggaacggctgaaagcattgtctgaacaatatggattccaattgatcgaagatgccgcggaagcactgggaacctgttataagcaggggaaatacatgggtcaatttgcagggaccattggggacttcgggacctattcctttaacggcaataagatcatcaccacagggggaggagggatggtaacggcaaaggatgaaaatgccctggaaaaagccaggtatcttgccgcccaggcaaaagacgacccctttttctatactcacaaggaagtgggttataactaccgcatgacaaacttacaggcagccctgggagtcgcccagctggaatgcctggaggattttatccggatcaaggaagccaattatgagtactacagaaacgccatacaagcaatggaaaactttgagctgcttccctttaaccaaaaggccaggaataaccggtggttttattccctcctcttaaaaagcggcgggccggaccgggatagggttatgaagcggttaagggaaaaggatattgaaacaaggcctatctggcagctgattcatacccagaaaatgtatgaggattgccaggcctattttatagaaaaagcacccctttactggaaccggatcatcaatattccctgcagcaccaaccttctaaaaaaggacatggattatattattgaagcattaaactgcatttagcagtctgaaagagggataggcatggaagttcataaatttatcattgctccggaccgttccattcgggatgcaattaaacaattggaccagacggcaagaaaactccttgttgttgaagaggatcataagctggccggtgttctcaccgatggggatatcaggcggtggatattaaagaataaagacatttccatgccagtgcgcctgatcatgaacaccgctcctgttgttataaaaaaggataaaagccatctggccctggaaatcatgagagaaaaacaaattgaggggctgcccctggtaaatgacaataaccaggtcactgatatcctgttctggaatgagctgagcggtcatgatccgggccgttcccaacagacccagacgccggtagtcatcatggccggaggcaagggttcccggttatatccatatacaaaggtcattccaaaacccctgattcccataggcgatatccccatcgtagaaagaatcatggatcagatgatggagtacgggtttcatgaattctatctcaccataaattataagaaagagatgataaaagcttattttaacgatgaccgccgttatcatctgcacctgatcgaagaagagaaacccctgggaacagccggttccttaaacctggcaaaaaaggatataaaggggagctttctggtaagcaactgcgacattttagtggatgtcaattacaccaagcttctcatgtaccacaagacccataaaaataagatcaccgttgtcacggccatgaaaagctatgagattccttacggagtgatcaccctgggagaaaacggaagcattgatgccttaaaggaaaaacccagatatgagctgctggtgagcaccggactttacgtattggaggaagaaatactaaaatacattcctgataaccagtattttgatatgacggacttaatccgcaggtgcttaaaaaacggcgagcaggtaggcgcctatcctgttatggacagcgcctggctggatatgggggaattcagtgaaatgaaaaaaatggctgaaagaatgaaattatgaaaaaagaattgattctgatcggcggaggcggccatggggaaagcatcatagacaccatccggggattggaaacttacagcatcgccggcatcctggatccaggaaaaaaagcgggaacagatgtactgggcataaaggtaatcggaagcgaccaggatttaacctatttttttaatatggggatcaggaatgcggtgattgccgtaggaagcatgggaaaccccggcccaagacagaagttataccaattatgccggaatatcggctatgaacttcccaatatcatcgacaaaagcgccatcctctccgaaactattaaaatgggagaaggaaatttcattggaaagggagtcctcatcaataccggcgttaccatcggaaacggaaccattatcaatacaggcgccatcctggaacatggctgcaggatcgaggactttgtccacattgctcctggatgtgtcttatgcggaaatgtccaggttaaggccaatacccatattggagcccattccaccctcctccagggtgtgagcattggtaacggcaccatgatcggagcaggcagtctggtcctgaaaaatatatcatctaaaaagctggcctatgggagtccggcaaaggaggtagcttcccatgagtaaagtcatgataattgccgaagcaggggtaaaccacaacggcgatataacgattgccaaacaattgatcgacgccgcaagcatcactggagccgacgccatcaaattccagacctttaagacaaatctccttgtggtccctgatgccaggaaagcggactaccagatagaaaataccggccatgccatgtcccaatatgaaatgttaaagagcctggaattatcctggcaggcctttgaagaactggtccagtactgtgccttccggcaaataacattcctttcctctccttttgatgaggaaagcctccttttccttgaccggcttggggttgagcccataaagatcccctcaggggagatcacaaactatgggtatttaaaaaaaattgcttccttaaaaaggaaggttattctgtcaacgggaatgtccactgaggacgaggtgggggaagcactggagatcttagaaagcagcggaaaggaaattatcctgctccattgttccagcgcttatccaaccatgatgttggatgtgaacttaaacgccatggacaccttaaagcgcagatttcataagcaggtgggatattccgaccatacgccaggaatcgaagtggctatcgccgctgctgcccttggcgcctgtgtcattgaaaagcatatgaccctggataaaaccatgcccggtccggatcacaaggccagtctggagccggatgaattcaagcacatggtggacagcgtcagaaacattgagctggcccttggggatggagtgaaaaggcccacagaggcggaactaagaaacagagatcatgtgagaaaatatctggtggcttccagggagatcagacagggggaagcctttaccttaaataacttatgcgccaaacgctgcggctatggaatctctcccatgaaaatccacagcctgttagggaaaacagcacaaagaaactatgaaaaggacgaaaggatcgaccaatgatcagattatgcgttgtgaccggaaaccgggcagagtacggcctgttaaagccggtgatggaccgggcccttcaggacccggaatttatgctgcaggtgattgccaccggaagccatctggataccagatatgggaatggctgtgaggatatagaaaacagcggcataaaagtcgatgagaaaatagagatgaacctggcctcagacacctcctctggaatctgcaaatccatgggcctggaaatgatcagcttatccgaagcctatcagcggttaaaaccggatatggtggttctgcttggcgaccggtatgaaacctttatggcagcaagcgccgctgtcatctgcaaaatccctatcgcccacatacacggcggggaaataacaaagggcgcattcgacgattgtatgaggcacgccattactaagatgagcaaccttcattttaccagcacaaaggaatacaggagacgggtcattcagatgggagaagccccggatagagtctattgggtgggagcccttgggatcgaaaacatgaaaaccataaatctgctgaccaggcgggaattagaggaagcattaaatatcccactgaccccgccaatggctcttgtgacctttcatcccgccactttaagccagaaaaacgcttctgcacagtttcagccattgacagaggcccttcttcactttccggatttatttacagtctttacaaggagcaattccgacacaggcggaaaccggatcaacgaaatgatcgacgtttatgtaagggaacatcccaaaaaatcggcggtattcccttcccttggggtacggcgctacttaagcctgatgaactgtgctcaggccgtgattggaaattcctccagcgggatcatggaggcgccttttctcaaggtgccctccgttaacattggaagcagacaggatggaaggataaagccagcctctgtcataagctgcggttcttctgcaagggagatcacggcagccatccaaaaagccctggactttaacctgcgccaggaggaggttccaaacccttacgagagccgggataccagcaggcagataattggtgtgataaaacaggagtttcataagggaattcatctggaaaagaatttttatgatgtggagtggaggatgtaatgtataaagacaagacttttttagcaatcatacctgcccgcagcggctcaaagggaatcatagacaaaaatatcagagaaataaaccacaagcctcttatggcatatacggtggaagcctgtaagcgctccaagatcttcgacgatattctggtgtccacagactcagttaaatacgcaaagatcgcagagcgcttcggagccagtgtgccgtttcttcgccctgaaaagctggcatctgaccaggcttcctccattgacgtcatacttcatgtactggaggagatggaacgtcatggaaaaacctttgactgcttcatgctcttacagccgacctctcctctcagaaacgaaacccatatgatagaaagcgctcatatcctggcagagaatcatgccgattccgtcatcagcatctgtaagtcagaacccacctcctacttaaccatacggcttacggatgaaggaatggtaaaagtcccgttctcagataaaaaacaggtgagaagacaggatattcggcccgaataccgattaaacggggccatctacctgtctctgaccagttattttatgaagcataaaagcttttatgagggcaggactctgccctatttcatgaatgcctttgattccgttgacattgacgatgattttcagtttaaaatagcggaattgcttctgcttgataaagagttatcaaatcctgccaaaaaaccttcccttaattttcatcccttatgagaccaagggccagaagagcacttttctcaagttcttctgctgttgtaaattcttttggcgtatggacttcgttcattccgcaggcaaccacgatcccccggatcccattgcggacaaaatggttgttatcgctgccgcccagggtatactgggtggtgccttttaagccaagggaccggcacacccgtttaaaccgttccaccacctcttcgccgtcccctatttcataggcttcgatctgcttttcaaagacgatttctaagcttcctccatatgagacagccgtacgttcaaaggtttccttcagtgtattccattcttccatagccttatgatcctttaagcttcggatctcgcccaaaacaacacattcgtcggaaacaatgttggtctgctttccaccgcttatttttccaatgtttacggtggtatcttcatccacccatccctgttttaactgggaaattgcatgggctgcgatctcaatggcattgatccccagctgggggcagaagcctgcgtgtgcagttttgccctttacctcaagtttaaaggaaagaagggtaggcgctgctgttgctgccaggccgatctccccgcttagatcaaatacataggcctgctttgactttatttttgaataatcaatgagctggctcccttttccgtagttctcttccgccacagggaacaggacttcaatatccgggtgggaaaggttattttcccggatcacccggacagcctcaagtatggctgcgatcccggaaaggtcatcggcaccgagaaccgtatccccttccgatgtgatcattccctgttcatcttccaccgctctcttgccgattccaggctttaccgtatccatatgggctgacagcaatatgggggatgaatttgaggttccctttaaaaagccgtaaagatttcccgtgggagctgctgttccatattccggcagcttttctttcagccggtaaccggcatcatcctcccacacttcaaatccaagctgttttaattcacctgtcaaataatctgcgatttcccgctcctgataagtttcggaatcaaattccaccatttttttaaattggcttacaagcctgcttctatgaatcatacggtcacctgctcttttcatatcagttatttttttacatcatcatatcttttaaacttttcttccggcgttttgcttaattccttccggttctgtggagccgaccagatgccctcataatcgatctggttcacaaaacgggaattaaaatcctggaaaaaggacttgttttccgactggggcgccgcaatatcccggaagtaagtattgtttctgaatgcaggaatttcatacaaatccctgcaatatccccagatgttttcgtaatcaaccactctgtgcttaatggggcctaagttccggtaataatgggtgtcaaaccttgccagggtcacaaaaagccttacatcgctgtccgtcacgtaatccccaaataaaaaacggtttttagacaggcgttcttcgatagaatccagagcgttataaaagtcttcaaacgcttcttcataggcttctatggactgggcaaacatcatccggtaggtcccgttgttcacattaggaaaaagccagtcgttgtaatcgtcgatctcttttctaagctcctcaggatataagtccggggcatcgggattctggaagggacggaaggctgtttcaaagtaattggtcagcctgtggtaatcattgttgaccacctgcttcgcagtaacatccacaagggccggaaccgtgcagcgtccttcataatccggatccgcattataataaaactcgcttaagtactgagcgccaaggaccgggtcctttctgtcctcattatacacgaattcccagccatatgcactattttctttgctgtggcccactaaattaatgccgatggcatctgaaaggcccagcagctcccgcacaatggaggcccggttggaccaatggcagccttttgcccaaaacaaccggtacctgcccttttctgcctttagatcctgttctccatctccaaaaggagttgtaaaccggttaggctggcggataaatgcacctctttcgtcgatttccttttctatttcctttgggcgtaccttttgcccgctgcttaaatctgccatgtgaatttcctcctattcctttaatattttttccgtgtagatgatcttaaaaatcccggtatccgtctgcctgttataatctgctttgtagcccagggcttcgtaaaagcctactgcctcatcccggctggtgatacagatttttttaacaccggattccctgatccagttttctgcctcttcaatcagcagccgccccacgccctttttccggtattctgaaaggacgctgacccgctcaattttagccgtttcttcattgtcagaaacatggatccggcaggctgctacaggataaatgtcatcaagcaccagcacatagagagattcttccgaatccccttcatcaaattccttatgcagcggaatccggaatccttttaccattgtttctgttcttacataatgaacgcctgcaagctgccagtgttcttttacccttactgccttcatcctgccgcccccttattcataattgatcctgcctcttccatgaggtattttccaaatggaaaggtctggacccttgggtaccagataataggggtttccggaaaccgcacacaaatgataatgggtcttaatagcctcaaaatctgtggtatccccaaatcccggctgtgaatataaatctctggcatatccccaaagattggggaaatcggaaataagacttctgttcagcagaaagccgttgtaataggccgcatcaaaccgggccagggtcacatatagcctgatatcagattccgtgatcttgtctccaaacagataacggctgcggcccaaccgctcctccagccagtccagacggtgaaagaccaggttatatgcctcttcataggcctcctggcttctggcaaatcctgccttgtaaaccccgttgttgatctcatgaaacaggatctcatttaattcatcgatttcttctctcagctcttttggatacagatccggcgctccctgcctgtggtatttcttccattccacttcccagtacctagtcaggttaaaataatcgttgttcaccacttttcctgttgccaggtcaacgacggcgggcacggtaaacctgccctgataatccggatctgccttttggtatgcctcgcttaaatatttgatctttaataccggatcttctccctgttcatccagggtaaacgcccagtctgtccgccccacatcaggccttatgggatccagagttcccaggctgaccgcatcctggagtcctagcagactcctgacaataacagaacggtgggcccatgggcaggcaggggaccagagcaaacggtatctgcctgcttctacaggcagctgcccttcttctgttccaaaggcggttgtaaaccggtttttctgccgtttaaatttcccatctgcttcgatctcatcagtaatatatttttttgacattgcaatttcctcatttctttctaaaagccagcttaacgcttcatatcctctctgccgtattcatcaacaaagcgatacgtttccggaagcaggaatccttccttatcgatccagttaagggattcttcagacccatgaaacaaacacatggccgtcttactccttcggaatcccattttttcgtacaaggccacagttctgggatgggtataaaggatcacgttctggcctctgacctgatccaggagcaactggatgagctttctgccgattccatgcccctgatattcctcgtcaagagcgatgttataaatggccgcctggcatatcccatcggataaggctctcccaacacccacgatcctttccctgtcgtaaacgaacaccacagcataactgtttgtgaagatgatttcctgctccattggggaacggtctgacaatccggaacgccgcagcacgtcagaaacttccttccagttaatttcttcctttgtcagcttgtatgtaacatcattcatgggaaccctcctgaaccttgatttctccgtccgcctgaatctgatgacggaatgtgctttcaaatacttcgattccttctgccatgtcatttccccctgtcaatcggatgttccattccgcttcactgcctgatgagtttaaatcgtataatcagcgctttccagcatgtgaatctttactaaaaactcctttagccgttggttatttggtttatcaaaaatctctttgggagtcccgtcggccacgatttttccattttccaggaagatgatccgattggccacgttcttcacaaaattcatttcatgggtgacaaggagaatggtattgccttcctgggccgccttttttatggtcaccagcacttcgcttaccagctccgggtccagggccgaggtgggttcatccatgagaagcagcttgggatccatagcaagtgcccttgcaatggccaccctttgctgctgacctccggataaatgcctgggataatgggataaacggtctcccattcccactttctgcaaatgcttttccgcaatggatttggcctcgcttttcttcagcttttttacgatcatcagcccttccatgacattttccagggcggtccggttcttaaaaagattaaactgctggaataccatttccgtactctttctcaattccagcttttctctggctgattttgtggtaagatcaatttcctgaccgtttatttttatggtccccttctctggcttttcaaggaagttaatggaacggaggagggttgatttcccggttcctgagggcccgatgatggcaactacatccccttcgcggatgaccagatcaacgttatccagtaccacgttatcaccgaatttcttactcaatccttttatttcaataacgttcatacttactcctcctttccctgagcctgctcatgctttttttgccggaacgccctgttttacccggtgaaatgggattcccgccggacgcttctgctgcaaccgtttccggtacactcatctttttctcgatatatacaaacagccgttcaattatgatcgtcagtccccagtaaatgatggccaaagagcagtaaacttcaaaataccggtagctgtttccggcaaggatcttgccctgagccgttatttcaaccactgagcaggtaaatgcaagagaagttccttttaccagactgatgagggagttccccagggagggaagagccactgtcactgcctggggaacaatactctgcggaatatttgaacccctgtcattccaagagctttggccgcctcaacctgccctttttccacggattgtatggcagcccgtatggtttctgaatcaaaggcagattgattaagtcccaaagccacaattgcaaaaataattggcggtattgcatttacgttataggaagttccattgtaaaagttataatattttaaagcgataggaattccaaagtacgtaagatacagctggacaataatcggggttccccgtacgaccgaaacaaatacggtacataattgccgcaggaccgggatattgtggatttttactatggcgatcaaaagccctgccacccaaccgatgagaagggcaattgccgtcagctgcagcgttacaggcaagtatttcagcaatgcaggaatttccgtaaacaccagcttccagtcaaatattttgctcatcttgttcctccggttttattaataagatggggaataatcggatccaaaccactttaagttgatttcctttgaggttccatcctgaatcacttcttttaaagccttgttaatatcttctgtcagcgtatcatttcccttgctgacgatcagataactgaagggttcttccatcaagtcctttgaaagtgtgttgctgatggaaactccgtccacattaaaattaaattctttctgataatactcgaacattggtttatccattaacacgaaatcatattttccgccttccacatcctggatctgcaatacaaggtcctcatcgctgtattcgattgttatggggcttgaaggattggcggagttatagttttccagggctgtggtaatattgatccctgcctgggagatggtctttaagcctgcaaggtcagcccatgtctcaataccagctgctttgtcactgccctttgcaaagatggcaacatattcattggcaaaaatggggtcagtgaataaatacttttctttccgcttctcatttttggcaaaattgttcacaccgatctggtaccggtcggaatccagacctgcaaaaatagatgggaaatcggtaacttcaatctctagtttatattggggaagccggtcgaaaacagctttgatcagttcaatgttgtgaccggtcagctggttgctgctgtccacaaaggtaaagggctttggagaaccgcctgttgccgcatgaaccaccaccggttcagccgagtcagccgttcccgcagcctcactgctctcctcctgctttgccgtttcagccgtactttccgtttttgctgtttcaccggctgtttctgcagccgccccattggcggtgcccttgcatccggtcagcgctcctaatacggccactgccataagcactcctgcaattgatttgcctgcaatatttttcttcataatcatttctcctcttttttccttattattggaatttcccaaaacatcatctgacggtaagttatttcctggaaagcggtctcctcattactgcaattcctggggaacaaaccacaagcctgtgttgttctctttcatatactctttaaattcgtcggaatgataagctgccacaatatcctttgcccattttgtatctttgttttcttcctttacaaccacctgtaaaatcagatgatccagaatatcttcctgtaaaatggcggtggaagggtcaatgcctgcattataaacaatgcttcctgtaataactgcaaagtcaaaatcatccaaagcaggaggaatgtttaacgaatccatttccacaaatttgatgttgtacttgttttccacaacatccgattgctttaccttttcaagaggaacatccggattgagcttaatccagccggctttttgcaaaagcgcataagcacgtgccgtattggatgcatcatttggtactgcaatcgtggcaccatcggctattgtctccaaagatgtgtgatttgcggagaacaatccggctggaacggtgggtatgggggaaatgggaacaaggtttccgttttggtttttgttgaaattatccgcataggcggtgtgctgctccacgttaaaatcaatttcaccttcatttaaagctgtgtcgttttgtaaaaggtcggaaaaatccaccacttccagtttatatccctgcttctccaaaataggctttaccgcctcttcaaacagtacggtatacggtcctgccgccttaccgtatttcaatgttgttttgtcctgaccgaccttgcttccggtgttggcggagcagcctgcaacggcgacggcaagcaaggcagcgataacagataatccaaattttttcataattaggttcctcctctatttacgtgttctcacacgttttgataaataatttccaaacccctgaatcagctgaacgaacacgatcagcacgattacggttgcaatcatcaagggggtattaaactgctgataaccataggttaatgccagatttcccacacctccgccgccaatggcgcctgccatggcagtggctccaagaaggccaatggtaccggtggtcagggacaaaattaaggatcccattgcttccggcaataagaagtgccagatcacctgcacgggggcggcccccatcgcttctgctgcttcgatgatccctttgtcaacctcaagcagggagctttctattaaacgggatagaaagggtgtaatataaaacaccagggaaaccagggcggcctgagtgccgatacgggtaccgactatgatttttgttaaaggcataattgccaccagcagaatgatataaggaactgagcgaacaatgttgatggtataattgatcaggttatagactgctttattctgcagaataccgcctttacgtgtaatggtaagcaaaatgccaagaggaattccaagaagcgacccaagcagcagcccccagaacagcatataaacggtctggcctgcggcaattgccatctgctctccggtaatgcctaaatattgctcaatcattgttctcctcctgttccccggttaaggtcaagacttccccatagactccggaatcttcaataaacttctgcacctcatcaaccttttcccttgagccgaacacctgcacaatcatgacgctgaacacgattccctgaagttcacaaaccgtggcaaataaaatactgttttccatgtgatattccgcacttatgcggtaaagcagcggttttccggcagtctttccctgaaagcgaaggcggaaaatccggttttctctctgatcgttccgtatttccctgaccaggctttccggtatgctgtcgttaatcacggtttttacaaaactcctggtaattttatgctggggattgccgaatacctgaagcacggtcccctgctccagaacccttccgttatccatgaccgcaaccttgttgcaaacatcacatatgacgttcatttcgtgggtaatcaggagaatggtcacgttcagctctctgtttatcttttttaaaagttctaaaatcgagtcagtggtctttggatccaaagcacttgttgcctcgtcacaaagcaggatgctgggattggtggcaagggcccgggctatgcccaccctttgcttttggccgccggaaagccttgacacattggtatagattttatcttcaagctcaacaaactgcaaaagctcatttacccgtttctcgatttctttttttggcactttgtttaataccagaggcgccgctatattctggaaaacagatttggactgcagcagattaaactgctgaaaaatcattccaatgttttttctcagcttgcgcaaatcctgtttggataaggtggtgatgtctatgccatctaccagcaccctcccctctgacggacgctccagtaagtttaccagccgtaccagggttgatttgcctgccccgctgaatcccaccactccgaaaatatcacccttttcaaccgtaaggctgacctgacgcaaggcatcaacttcaccggatgcagaatcaaaccgcttgcttacgttttgaatttcaatcatcggagttctcctcctttgcaggaatcaattcaccgttttttatggctaaaagagtcttttgtgccagcgccgcaaaataatcaactgccggttccaatgcgttagtgtcaacctgaaacttcgggtggtgattggggcaggactctcccgtacctatacggatgaaaaagcctgggactttttcctggtaaaaggcaaagtcttctccgccgagagacggcgaaggtgttttgacctttaagccctgttcttttgcaacagcagcggccacaggttcaaggctttggacgttatttgtagcaggcggccctgcaagccagtcaatttctgctgcagcaccctgggacagggcaacatgctgaaccagggtgcgaaagcgctcttcaatcagccggcggttatgtctgcccatggtgcgtatggtcccttcaagctccgctgtctggggaatcacattccacgtatttcctgcagtgacccgggttatgctgatcagcccctgggaaaatggatcaatattccggctgacaatgctttgggcaagggtcacaatttgtgaggcggtaagtaccggatcaattccgtcctgaggatgagccgcatgagtgccttttccagtaagcttaaccgtaaatctgtcaacagcggcggtgatgcttccggatacaattcctactgttcctacagggagagtgatatcggtatgcaggccgtaaatcacgtcaacatcatcaagcactcctgttttgatcacttccagggcgccgacagaggattcctctgcaggctgaaacaggatttttacccttccgtgcaaatgctcccgcccctcctgcaattcttttgccacatacagcatcactgcggtatgaaagtcgtggccgcaggcgtgcatttttcccgctatggaagaggcataaggcaatccggtttcttcctgcacgggaagagcgtcaatatcgcagcgcagggctatgaccggcccgctgtttgcgccttggatttctgctgccaaacctgtttttaaatccaggtccaggatatgtaccttgtgatattccaaaaactcacggatccggcgagttgtctcgtattcttcaaaagagagctcagggttttggtgaaaccaataaaacgtctctgtaatctggtgataaaacgtagaatgggacatgaacggtccaacctttcataatttaatcctttaaaacaacaatcaatactccgcttttttctttccgaatttttcgtccctgttattcggttcatcccaaatggaaacatccggtcccaggggaagaatgttgtatgggttatgtccatggtttcccaggagatatccccttttgattgcgtcaaaatccgtggcttctttaaatgccggaatcgtatacaaatcctttgcataattccacagattgtcaaaatccgcaatgcggttcctgtttgtcttatggctgaaatagtaggccacatcaaacctggcaagggtcacgtataaccggatatcagaatcggtgagccggtctccaaataaatatcttccctttgaaagacgctcttccagccagtcaagcctttgaaacagcacatcataggcagcttcatattctttctgggactgggcaaaacctgccttgtagactccgttatttacctcgtggaataaaatcacattcagctcgtcgatttccttccttaagtcctcgggatacaaatccggcgctcccggcttgtggaatggcttccaaacggtttcccagtaatttgtcaaacggtggtaatcgttgttgaccaccttccctgtttttaaatccaccacagtgggaacggttgcccttccttcatattccgggtcagtagctgcatagatctccggaagataacggattttaagaacaggatcaacaccgccctcatcaagggagaattcccagccgttgtcagttcttacggggcttaccttgccggcgctgatcgtatcttccagccctaaaagcttaagggctatgatctgccttgtggcccatgggcaaagaggcgtccatatgagccggtatctccctgcttccacaggaagctctcctgctcccggtccaaagggcgtgataaaatgattatcctgccttacaaaagcgcctgtttccgatacttcatgggtatcttctgtggtggctacctttccgaatttctcttctattgccatattttcttccttctttcccaaatttgagtacaaaaaaagcagatgtcctctgacacccgcttctctacgcattaacgccatgcataggagttccaggttttaagacacaagtaaaaagaccattccttaagcacttacagcaacaacacattagctccatctttccatccatctgaaacatctttgactcctttcccttcattcctgtttctttatgctgatatcttaccactcctataggtttttgcataatatataaaaaatacagctggcaataagattatcttataaccagctgttttccaaaccaccagtcattttatttacggaaatactatagcgaagtcaggcttgattgacttaggcccattgtcctcatgagaataagggagtagacagataccggtcaccggagtcaggaagcaggaccacaatggtttttcccttgttttccggtttttctgccagctgttttgctgcctttaatgcagcgccggaagatatccctaccagaattccttctgatactgcaaatgcctttccttccttaaatgcttcctcgttttcaatggtaatgatttcatcgtaaattccggtatccagcacttcaggaacaaagcctgcgccgattccctggattttgtgaggacctggctttcctccggaaagcaccgggctgcttgccggctctacggctacgattctgacatccggtttctttccctttaaatattcacccacacctgtgatggttccgcctgtacctacgcctgcaacaaagatatccacatctccgtctgtctgttcccagatctcaggaccggtggtttccttgtgcacttttggattggccgggtttacaaactgtccaagaatgaaggaaccaggtatgctggctttcagctcctcggctttttcaatggcgcccttcatgccctttgctccctcagtcagttccagctctgctccataggcttttaataagtttctccgctccacgctcatggtatccggaagtgtaagaatggtcctgtagcccttggctgccgcaacagctgccaaaccgatcccggtatttcctgatgtgggttcaatgatggttgctccaggctttaatatgcctttttcctctgcatcctcgatcatggcaagagcaatcctgtcttttacggaaccggccggatttaagtattccagcttcgccaaaagggtgacaccctcaattccttcctttgcactgtatctgtttaatttaagtataggtgttccgccaatgagctccactgcactttctttaattgttcccatattctttacctccgtttttatatgatatttattagtttgattaatataaaaaagaacagccgccaattacggcacctgctcctttattccgcttgtaatatgaaaacttctcatatcctaagctgtcaggtatcataataagcattacaacaaaaccgtattattatccatacatacagcctgacaacaacatctattattaaaaaattcatgatccattactatctttttccttttcataggggccatctcttttcattacctatatgtttaataggtttatatgttataattatattaatacactcaaagaaatgtgtcaatacttttttacaatttttttatcgatcctctctttacgcctgtacccgtattactgcttttcctgggggattttccatttattcctttttttctgataaatcaggataaatctggcaacactaatgataaacaaaattaggaggaataaaaaatggtcacactaaaagacagcatgacaaaagagaaccttttaaaagcttttgcaggagaatgccaggcctggcggcgttatgaatttgccgcatcccagtcaaagaaccagaatcttcaggttttatactggcttttccattatacaggaagccaggaaaaggaacatgctgaaatattctataaccacttaagagagttccatggacaggaaatcttcataagcgccgattatccaattgacaattccaataacattctggagcttttgcagctttccgccaagcatgaggctgctgagcatgatacgatttacaaatcctttggtgacaaagccaaggaggagggattttcccatattgcaaattctttttatatgatcgctgagattgagcaggtgcacagccagcgttttgcccagtatgcccagctggttgaaaacaacaagctgtttgaaaacgatacgcccacggaatatatctgcttaaactgcggccacgtccacaaaggtgccaaggctcctcaggtctgtccggtctgcagccataaccagggattttttgtccgccgggaagactcaccctttggaaaataaaaaggattgaaagctgctaaaaaacgccggaaacctgcaaaaacatcatatttttgcaggtttccggcgtttttcataacagagacaaagtcaggacagtgattggcaaaacaactgttctgctattctttacaacccctttacggcccgttccaggctctccatagcctgtttcacaatggaccggggacatgcgatgttgatcctttcaaatccctctcctgccggaccgaacatggcgccgctgtccagccagaggcctgccttctttacgatcaggtcttccctttctccttccgttaatcccagctcccggaaatccagccacaccaggtaagtgccttccggttctatgaattgaatggctggtattctttcctttaaaaactcccgcacataagaaatgttcgcccttaagtactccatgagctgatcatgccagtcctctccatagcggtatgctgcctcgcatgcggtcaggcccagggtgttaagctggctgtatccggctgctcccacctgtctgcgaaatctccgtctcaactgctgattggcaataaagatgttggaaatctgtaagccagccagattaaaggtcttactgggggaggtacaggtaatggtcctgtttttcagctcttcgcttaagtctgcaaataccaggtgttctcccttaaacacaaaatcctggtggatctcatcgctgaccacgatgatgtctctgcggatgcagatctcccccagccgatccagttcttctctggtccagactcttcctaccggattatggggattgcacaataaaaataattttatatgatattgctccgcttttcgttcaaaatcttcaaaatctatatgatacctgccgtcttctccaagatacagggtattgtccacaataatcctgtcattatcttcaatgacttcgctgaaaggatagtacacaggcttctggatcatgactccgtctcctggatctgtaaaagcctggaccgccatggctaaggcgaatacgaccccaggcgttttgaccagccatctgctttccaccttccaatgatgccttttttccagccagccctggactgcctcaaagtattcatcctggacctcactgtagccgaagatcccatgctccactctctcgtgaagggcttccagaattttttcgcttaccttaaaatccatatccgccacccaaaggggaagcaggttttccggctttcctctccgcagggcaaaatcatacttaatactgtttgtatttttacggtcaatgatttcattaaaatcgatcgttttcttacacataaaatatccgctccaattcctctatcaaatcttctgcatcttcaattcccaccgatagccttaaaattctgtcggtaacgccattggcagcaagaacctcttttggcacatcggcatgagtctgggtgatggggtaagtgatcagcgtttccaccccgcccaggctttccgcaaagtgaatgagctttacctcctttaaaatccggtgagccagctcctttgtttccacctcaaaggtgaccatacagccaaaccctcttgcctgctttttacagacttcatatccgggatggtccgggagtccggggtaatacacctttgtgatcttcttttcctgatacagccattccacaagcctcttggcgttcttttcgccccgttccatgcggatggcaagggttttgattcctcttaatataagccagctgtcaaagggagccaggccggagcctactgttttaataataaaccgcagccgttctgcaatctttgctgaagaagtgaccagaaagcctgcaatggtatcattatgtccgcctaagtatttagtcccgctgtgtaccacaatatccgcccccagctttaaaggattttgaaaataaggggacaaaaaggtattgtcaacgatcaaaagcaagtgattctttttcgccacctctgccagtctttcaatgtctatgacattcatcatgggattggttggagtctcgataaatatggcctttgtgttttcccctacaagtctttcaaactctgataaatctccggcggaacagtccactgagctgatcagaatcccgttctttttgctgatattatcaaacagccggatgctgccgccatataaatcacagtcagtaataatatgatcccccggctgaaacagctccatcaaagccgtgatcgccgccattccgctggaaaaagccagggcatccactccattttcaagggaagccaccaccttttctaactgctcccttgtcgggttctgtaaacggctgtaatcatagccggtactctctccgattcccttgtgggcaaaggtggctgtctggtaaatgggaaagctgattgctcctgacttgtccgtggaaacaccttccccattgccatataaacactttgtagaaatcccgtattccatattcattccccgctttctcttttttgaaatcatggttttattctttccacaagtataccaatggtatgcttccaaccgttattacttaaaaacaatagcctgttataatttattcctattgaaaaagaatttttatttcacaggttgaatacctattcaacctatggtaaaataggtattgatacacaaaattgcttagtaaggtggtatactatgaaaatatcgactcgcggccgttattcccttcggatgatgattgatctagccgagcattataatgatgatttcattgccttaaaggatatttccgaaaggcagagtatttcaaaaaatatctggaacagatcgttccctttttaaaccgcagcaatctgctcactacttaccgggggcacatgggaggttataagctggcaaggcatccttccaaaataaccattggggatattctgctcagctcagagggaagcttaaatcctgtcagctgcatggacaatgatcccaacgtatgtaccagacaggaggactgtatgactcttcccatctggcagggactgtccgaggtcattgctgactacttaaacggcattaccctgcaggacattcttgacagacgtccggattcccctgaatattatatttagatcgtcaaagcacctgtttttcatactttttcagctctgttatatatttttccccaaggatacttaagggcattttcctcttttttatatatccgatcctcattttatcatcggtattaagaggaattgccctgtattcatttccgtttaaatcttcacaaatgattccggagcacaaggtatagccgtttaatcccaccatgaggtttaaaagggtggccctgtcatctgcttttatgatctgcttatattcataagtgctgaacacttcctctgccagataaaaggaattgttgtttccctgttcaaaggaaaggcaggggtaattctttaaatcctcaaattcgatcacctctttttctgccagtggattgcccttccataaaaatacatagatcccgcactgaaacagttccacaaattccagttggttatcattaaagattttctcaatggctttctggttaaaatcatttaagtacaggatccccaattcgcttttctggttcctcacattttcaatgacttcataggttttggtttcatggacggcaaactcgtaatcatctattccaaattccttcgccatgtgaataaaggcctggacagcaaaagtataatgctgcatggatacgctgaatttctttttaaatttctccttttttacaaaccgctcttccatctgacggtactgctccagcatctgtctcgcatatccaaggaattcctctccttccggggtgatcacgatcccccggtttgagcgcaggaacagctgaaggccgatttcctcctccagatcccggatggtgcttgataaactgggctgtgtgataaacagctcggcagccgccttgttcatggatttctgatttgcaatgcatatggcataacgcagctgctgtaatgtcatggtttctctcccttctctgcattttgcactcaaaggctgccatagggcctatggcagcctgtttctgatctcttaagcttgcgggttacttaactgcttcaaacgcctcgtctaaatcctctattatatcagccccatgttcggttccgatggataaccggatggtattgggcttgattcctgattcctccaattctgcttccgtcatctgggaatgggtcgtggacgccggatgaatgactaaggattttacatccgctacgttggccaacagggagaataattccagctgatcaataaaatcctttgcctttctggcatccccttaatttcaaaggtaaatattgagcctccgccgttagggaaatatttggcgtataattcctgctgctcaggatcttcagaaacagaaggatggtgcaccgtctccacctggggatggttctttaaatactgtgccactttcagcgcattttccacgtgccgctcaacccggagggataaggtttccagtccctgaaggaataaaaatgcgtggaagggagataaagcagctcccgtatcccggagtaaaatagcacggattttggtcacgtaagctgccggacctactgctttggtaaagctgatcccgtggtagcttggatttggctccgtaaggggagaaaattttcctgaggcctcccaatcgaatttcccgctgtcaacgatgacaccgccgatggcggttccatgacctccgatatacttggtggcggaatggaccacaatgtccgctccgtattcaatgggcctgaccagataaggagttgcaaatgtattgtccacaattaacggaattttatgtgcatgggctatgtctgccagcttttcaacatcaaccacatcggaattgggattgcccagggtttcaatgaataccagctttgtattttcctgtatggccttgtcaaaggcttcgtaatcaaagggatccacaaaggtggtttcaatgccgtattccggcagggtatgctccagcaggttataggtgccgccgtaaatattcttggctgctacgatatgatccccgttttttgctatgttttcaatggaataggtaacggcggctgcaccggaggccactgccagggctgccactccgccctctaaggctgcgatcctgcgttcaaaaacatcctgggtaggatttgtcagccttccatagatattgcctgcgtctgataaattgaatctcgccgcagcgtgatcactgttatggaacacataggaggaggtctggtaaatgggaactgctctcgcatcggtaaccggatccgcctgctcctgtccaacatgtaattgcaatgtttcaaatcttaaatttctttcagatcttctcttcttggccatatggatttcctcctgaatgttatacggattattgacttcgtctcttcttagttggtattataccttgtttcccgtataagtgttaatagatattattatgacctggttataggcaaaacctataacaaagccagtatagatttttctcccaagctcatgcttatccatcatatatctttaagttttgaatatacatatacaaattaatagcgaggacatgaatcatgaatgaacattatccttttgtaaacctgcctctgccgtatccatacgatgcactggaaccctacatagacacacaaaccatgtatttacatcacgacagacttcagcagcggtatgtagcaaaccttaacgcgatcctaagagattatcctcagctgcaaaacatgactttggaagagctgctctcaaacccggaaagccttcccgaagaggcccgtcagggcatcataaataatggaggcggggtttataaccacatcatttatttcgccggaatgaccaattccatgacacggtcccaggccgaaacattgtttcctgccatcgtggaaagctttggaacggtggaacagttttttgatgaattcaaaagatacgccatgtctgtattcggatccggatatgcatggctggttgtggatcccaacggcacgttaagtttcgtaacaacaccaaatcagaattcccctatctcaaacggtctttgcgtaattgccggcatcgatgtctgggagcatgcctattttttaaagcgttttaatgaccgggccgcatacatagaagactggttccacgtggtaagctgggaagcagcggacgaacgttacaagctgtgcatcaacgctgaatcttaatatggatggcccggcttatatcattcaaattgtttccattttataccctgtcctaaaaaaccttcaaactgatgtacggatctgtttgaaggtttttattctttgggtatttcatgcaaaagtcttttggttcagtccggtaacaaaatccgcacttttggcggttacctccacccaggccggcctgaaaccgctttttatagcattccggaccgatttgatattggaccaggcagcgcagtaaaagggaaccttccccctgcctaaagcctcaaatgccatacggctggtcagtgcggtggcaatcccctttctccggtattccggcaagatatcaatgccgacctgccacatggtttcgcagtcagcggaacagcctgcaagccctaccagcctgccgtcatcgtaagcacctgccgccaaaacatccaggtgcttacgcttttcacacaaggcgttgctccactgagaggtatacagctccttaaactcctccggttccagaattttaatctcataaccgcagtccatgactttcaatgcacttaaatccggcagaaagtattcggccataaaacagatcctcatccctcttttctgaagctcatcgttgagtatgtgaaggttaggggtttcaaaacaatttataacagggtatttgttgatatattctttgacaaattcggcaatgtcctcatttaccgatgcaacaatattgttcccataagagaccagatcacagtaaaaaggcaattccagatattttctggcatttgcatgattagctgaaataacgattttattttcacttgtacagaaatccccaggctgacagttggcatcaattgctgactggcccattgcgatttccagaattctttcattcgtcatacacattcctcctggccggataatttaaataatgaaaaagaggagtctcggtgtcccggcatcagaatatctgatctttatcaatgatctttcggatccatccctccggtgcctctgtcgttcccagctgaattccggttagaagatcatataattgctgaataactggtcccattttctccagcccgctggcaaaacatatttcttttccatggtctactacctttcctaccggagaaatgactgctgcagtaccgcacaaaccgcattctgcaaaatccggaagctctgataagcgtaccgggcgctcagttactttcagccctaagtaatgttcagcaacatacaacatggatcttcttgtaattgagggtaatatggtgtttgattcaggagttacaatctcattatctttggtaacaaataagaaattagcaccacctgtttcttctacatacgtatgtgtaacaggatctaaaaacatgttctcatcaaagccggcatcatgggccgttacataggcatgtaaactcatggcgtagtttaaaccggcttttaaatgcccggttccgcgaggcgccgctctgtcataatcgctgacacataaggttaatggcctggcgccgcctttaaaatacggaccgaccggggtgcagattaagcgaaactgatattcatcagaaggcttcactccaataaccggtccggtagcaaacatatacggtcttaaataaagagatgcgcctgtaccgtatggaggtacccaggatatattggctgttacaacctggtctaccgcttccaaaaatttttctttcggaaatggcggcatttccattccccttgcagaatccatcatacgctctgcatttaagtccgggcgaaatgtaacaatgcttccatctttggccgtatatgctttcagtccctcaaagatttcctggcaatactgtaaaataccagcgcattcattcaatacaacattggcatctgaagtcagcaagcccttgtcccatcttccgcctttgtactctgacacatagcgtttatccgttttcctgtatccaaaaccaatattttcccagtccatatttttcttttccataaaaaactcccttaaatataaaattaatgaaagcatggcagcagcactgctgccatgctttcatctactatatcatcctaattgcaattactcaactgatttacaatattatccactgcctgccgtacatatgcagggtccgttgcaaggttcagacggacaaaacctttaaaattctcaccaaaccactcgccataatcaacagcgagccggcatttatcctgtataaattccttaacacaattctgatccacgcattttcgcagatcaagcagaaccagataagtgccctcaagatcacataccgtgatagcaggtgccttctcatttaacatatctcttaaataactgtagttatcctcaataatttccaatacatgatccagccattcctggccatgtgcataagccgccatcgttgcagccacgcctaatacgttgatttccgtacgatttaatgcacttgcaaacttatcgtagactgccctcaaagattcattggttatgatgatatgagaatgcaaaaaatgaaaaacaagaaaatatttacttagctaactattgattttagaaatcaaatgtgttacattattaacaaatttaatcacggtattgacaaatacctgtggaaaggagatagtgttatgctgactacattcaaagctactgcaacaaaattatccgatggtttacaagttgaaacaaattcaagaggttttaaaatactccttgatgagcctgaggaaatgggaggcactgatgctttcatgaatcctgtggaggctcttttatgtgccctgggagcttgccagacaatcgtagcaaccgcatttgcagctgcccacgacatcgtatttgaggaatttcatgttgaacttgaaggggatttggatccggatggtttcatgggcttagccaatgtaagaaacggctttcaggaaattcgctttgtaatgcattttaagaccaatgaacccaaagagaaaattgaaaactatgcaaagtttattgagcaaacctgccctgtaggcgattgcctggctaatggtgtgaaattagtattatcaggtgtggcaattgactaattaatacctacatacagcaaaagagcctttttataattggctcttttgcttatacgtacaaaaaataaaggagaatatcacatgatcattaaaatgccagcaatccctggcggaaaaacaagtaaagtaggaaaaataaatgtaaaagttggcgataaagtagctgtcggcgacatccttgtgcaagtagagacagcaaaaggaaatcgcccgataaaggcaacatcggatggcgcagtttttagaatattatgtgaagaaggttccgaaattgccccaatactgaattgtttgatatcacggaatgtttggttgctggaaaatcaacagaatcagatttaaaagacatggcgcaaacagcttctgtggaactctccacggatttacttataatcggcggaggaccagggggatacgtggcagctatttacgcggccaaaaacggtttaacggtaactctggtggaaaaatcagagttagggggaacatgcttaaatgtcggctgtattcctactaaggcgcttgtaaaatcttctgaaatctgccataatgcaaacacagcttccattttcggcgtagaaatcgaaggtagaatctcggtcaatatgaagcaggtcattgcccgcaaggaccagataaaagataagcttgtttccggaattgattatctcatgagtaaaaatgaaatcaatgtaatctccggtcaggcgtcttttattgacatgtataccgtcgcagtgaatggaagtcaaagctacatgattaaagcaaaggatattatcatagcaacggggtctaaaatttcaaaaccggcaatccccggtctggacctgccttttgtattaaacagcaccaccgcgctgtctgacacggatcttcctaaatccattgcaattattggaggcggggtcattggtatggaatttgcgtttatctataaaaattttggcgttgatgtacacgttattgaatttatggatcgtatattaaccatggttgacaatgacatatccaatgaaatgcacgctattgcagaagaagcaaaaattaagatccacactggctcaaaggtgttgaaaattcaaagttctattaatgatgcggcagtcattacctatgaggataaaaatggtgagcatttgattgtaagcgacaaagttttagtagctatcggcagggagcctgatttagatgggctatcacttaatcatagcgatgtctcattaaacagcaggggaagaggcattcaggtagattcttccatgcgcacaaatattgatcatatttatgcaattggggacgtaacagacattattcaactggcccacgtggcttctcatcaggctattgttgctgtagacaatatattagggaaaagtaaagagatggattactcggccgttccaaatgtcatatttaccactccggaaattgcaagcgttggtataaacgaagataaagcaatggcagagggaatggatatcacgatcggcagattttcatttaaaggaaatggaaaagcattgacaatgaatgaaccacggggttttataaaactggtgaaaaacaacgattctcaaaagattatcggaggatctattataggccctgatgcttcctccttaataagcacactgactctggcgattgccaatggatttaccgaaaaacaaataacagagacaatattttcacacccaactaccagtgaggtgattcatgaagctgcactggatcttggaatcggagctttgcaccaataatgaaaaaaaataatagtttcaaaagaatttgatccatattttaacatcgctgcagaacatcagttgtttctggcctctgacgaagatatccatctatttctatggcaaaatgatgcttctgtgatcataggaagaaaccagaacttatacgccgaatgtaatctttcataccttaaggagcagaatatcaaggcggttcgcaggttttccggaggcggggccgtataccatgataagggaaatgttaattttacctttattacaaaagaagccttggcaagtcatgtccagttcatagaaatcatccaatcagtaatgttgagactcggtattgattgtgaatttagcggcagaaatgatttgctgtataaaaaccagaagttttccggacatgcttattatactgataacgataattatatgtatcacggcacaattttagttcatgtggactttgggcggttagaaaaagccctcacaccctccacattaaaattacaatccaaaggagttaagtccgttaaaaacagagtcataaacttatcagaaatcagtaagaaaataaccacagaaagagtaatagaagcattcatcgagacctttgatagtaaaaaaatagagtatattaataaaactaactttaatgcccctttggaatcacttctctcatcttatgattggctgtatgcacaatcacccaatttcgacatcgtattggaacgtaaatattctttaggaaacgtatccgtgcacatctcaatatctgatgggataataaaaaatgccaaaatcagtacagacagtctgcagctttatgatttcagaatatgtgagaataatctaagtgagaaacaatttgacgaagcaacaatatgggagtgtatggacctgtatattctaaaccatttaaaactatcttaattctgtcctgccagcaaaaaaagtatagtatacttaaatcttttatgttaatataatctatataaacaaaaaggaattagatggtgatgaattatgtttgatttagatgactgtattgcttttataacctgcagaggtgcaaagaaattagccgattgtttagaaaaaagattaaatcattataatattacaagatcccagtggattgcattatattatataaaaaataacaacttgattacccaaaagcaattatcggacaagatgtcactcaaagaaccaagcgttgtacggttaattgataagatggaagcgcttgggtgggtgcatagagtgaacaatgaaagtgataaaagaacgaaattattaacgcttacaaatgacgggataaaaattgaagatgagatgctggcaatcactgaaaaatttaagtcagacgtacttaatggtcttacccagctggagcttgacagcttcaaatcagccttaaacaaaatgcttaataatatagagactacaccttcttttccacctggctccaattgattttacacgtgcattcttcagtctttgtttttataaaaagatattcctgatctgctgatttctaataccatgtataaagaggaagcaacacctcatttatgcatggtattttttattctctcctctcctgctcacagacccctcatcatttcccgatttccgaaaaaatgaaagcgcttctgcttattgcctaagttaacttttccactgggctttcagcagctacagaggctttcctcgcttcaaatgaagcggcatcatcccattttttcactgcctaattggccataatcgacaccaggattaaagttacaataacagcacaggcacactgcgcggttgcactgtacagtctcccggcaaagaaaaagacagctactcgctgtcctcttcctcataagcttctctgttttcttcatgcctcagcgtattaggtcccagaaaatgtcctgttccccagtggttgttgaaagtattgacttcctcagccacatcttttttaggcttccgattttccttgtttttctccatattatcacctcagccatagtatggacgattattagaagaattatgttggaaaagaaaacacccatcgatcaaattacgacaggcgttttcaaaaaaaaggagggaaatctatgaataattgactatgaattttatgtcgtatacggataatcttacaatgttaagatataaagcttcgacctgtcccgtgactatcttgaaatttttttattaaaattatttagtcaagaaaaatcatcgttttcaatcggccactaagccattacacatggcagccgcagggggccaaatttacctgattttagatatcatcattataaatcagccgtgtggacattacaaagacacgatttgtcaatagccctgatccagtacattattcccttacagcctccaaggctgctgtccttaccagctgctctgctaactcttttttcaaacactcgcgtccctgatgccaatttttccatcaaatcactgttattttatgaataatttttgatttattgggaattataattgtgtcccatctcgtgtataagcctgagtaaccttccttttcgttacttgggcttttgtccctctcaagtgctccagtcttcgtcctggtgctttacccagtctccgatctggacataaactcctatatgtataagccggcctcgttgcaaagaaggtcgttgcaggcaaaaccttaattgctaaggctgcctcagtgtgatcctctgccatgctcatattgcaaccggcgctcttttggtgaatttcttaatgtatccctcctgcctttttccttttactccctattgccatcaagaacatatgtttgctataattcctattatgcaccagaacgtacgtttattataattgccaccgaggtgatagtaatgccattttatattgatcgtccatgcccaaaagaaaccattgatttatcctataatcgcactttaccggtgatcgccagctttaatgcccgcggcgattgcgtaccaatttattttagatatatttttactgacggtacttacactgatattgccattgatcgcgttgtaaatattgataaacgcttccgtcagactacttatatttgtgatgttactgcaaacgatacgcgccaaaaggtgacacttacctattttcgggaggacggtctatgggctctcaagaccaattaaataacagttttcttgaataatttgatgtttaaaaaactttatgccgtaattataaatagccagtaattttctttatatattcattccattggacttcagcttccacctcgcgatggacacccttggtcttggctatgtccttcccaccaccagggcggaccagggactttccattagaacgtgcgcccgctgggcgcaccacaaaaagaggagccgcctaaagcgaactcctcttttctctatcaaatggtattttacctttaaaaataaaggtttatccttagaatttaccttcttttgcactttcctcgatcccaacagccacagcaacggtagcgccgaccatagggttattgcccataccgatcagacccatcatttccacgtgagccggaacagaagaagaacctgcgaactgggcatcagagtgcatacgtcccatggtatcagtcataccgtaggaagccgggcctgctcccatgttgtccggatgaagggtacgtcctgtaccgccgccggaagctacggagaaatatttcttgcccttctctgtacattccttcttataggttcctgctaccggatgctggaatctggttgggttggtggagttgcctgtgatggaaacgtcaacgccttccttccacataactgcaacgccttctgttacatcgtttgcgccgtagcagttaacttttgctcttaaaccttctgagtaggactttctccaaagctcttttacttcgcctgtgtaataatccatctctgtttctacgtatgtaaatccattgattctggaaatgatctgagctgcatcctttcctaaaccatttaagataactcttaaaggattctgacgaaccttgtttgccttctcagcaataccaattgcaccttctgctgccgcaaaggactcatggcctgctaaaaaacagaagcagtctgtctcttcttccagaagcatctttcctaagttgccatgtcccagacctactttacgctggtctgcaacggagcctggaatacagaaagcctgaagtccctctccaatggctgctgctgcgtcagatgcttttctgcagcctttcttgattgcgatagctgctcccactatgtaagcccaacaggcattctcaaagcagatcggctggatcttttttacctgctcgtacacatctaagcctgcatcttttgtaatcttctcagcttcttcaattgaagcaataccatagctgtttaatacagaattgattttgtcaattcttctctcatatgattcaaataatgccattatcttgtcctccttattattggccaaatatcttcgctttgataaccggtaaccgacaatcctccgacaatccgattattcatgtcttgggtcaatgatcttagcagcatctgcaacgcggccgtactgtcccttagccttttcccaagcggtgttcggatcatcgcccttcttgatgaagtctgtcatctttccaaggcttacgaactgatagccaataatctggtcttcttcatccaaagcaatgccggttacataaccttccgccatctctaaataacgaggacctttctttaatgttccgtacatggttccaacctgtgaacggagaccctttcctaagtcttccagacctgcacctacaggaagtccgtcttcagagaaagcgctctgggttcttccgtatgcgatctgtaagaataattctctcattgctgtattgatagcatcacagacaaggtctgtatttaatgcttctaaaacggtcagtcccggtaaaatctcagccgccatagcagcggaatgtgtcataccggaacatccgattgtctctactaatgcttcctgaataatgccctcttttacgttaagagtcagcttgcatgcgccctgctggggagcacaccagccaacgccatgtgtcagaccggagatatctttaacttctctagattttacccattttgcttcttccgggattggagctgcgccgtgatgaacgccctgtgccactatgcacatctcttctacttcctgtgaataaatcatgttaatactcctttcgaataagtaatcattgtgaacagtactttgttaattatatcacatcatacttgatcatattttctcatataatgtcggtttccgcaagtattttttccaaaaaagcagggaggaacgaatcctccctgctttttttgttctttataaaattctcctgacggaaagaatggtccggtatgtagctgttcccactttaattccggttgccggggaacttgcatgaacaatttgtccattgccgatataaatccctatatggcctgcatagcagatcaaatctccgggctgggcctcagaataagatacctcacgtcctgcggagcgctgctctgaagagcttcttggaagagaatatccgaaatgcctgtatacggacaatacaaatccggaacagtccgcaccactggtcaggctggttcctccaaatacataaggattccccacaaactgaagcccataatctgcaaccgcacgtccttcggcggttccgccattgctcttgttggctgtgggaccggtgtacttgttgttggcattggaggacttgggttttgagctggtgttagcagcagccttctttctggcctcttcctccgcctttttcctggcttcttcggctgccttcttcctggcctcctcttccttcgccttgcggatctcctcattcttctttgctaccgtctgagcataaactgccgcatcctgcttggcctgtgcaagctggctgtcaaaattggaaacttcctttttcttcgtggagatcagcgtctcaagctgggactgctgatccttatactccagctccatgacctccatctcagccttgtcctcttctaagtcagacttataatcggccaccttctgctttgtctcctgaaaggtgatcagcatgttccggtcgtatgtataaattccttctacgtattctgccttattaagaaggtcagacatgtttttcacctgaaggaaaatatccagatattctgtatctcccttttcatacatgtactggattctctttttcatggaagcatactgcttttcttcatctttcttagccgcagcatagtccagctccgcctgcttgatctctgcttccttgttggccatatcactttccagaaccttgatatcagacaaaagagcagtcaggtcagtggtcagctttgatacctgattctgggcggcactctttttgctttctgcgtcctgagcctttttatttgcctcttccaactttttctgggcttcctgtttctctttttccgcttttgacgtagcccaggcgggaacagtctggccgcagaccattgcacttactaacaggccgcagagaagcttttgcagcatttttctgtttctttcatacataatctgtatttttcgtttcatcgtcagttccttttccccttttttctaccttatatgttaccgtataaccagggtaaaattcaagtcctattttggaaaattttgatatttttaagatacggccaaagttcctgcctcttcatccctcataaatttcaattcattcaatattttcaccactatgaccgtggcaaggacaaaggtaaatacatccgcaaccggctgggatatctgaagtcccaggacgcctaaaaatcctggtaacaccagaagcgccgggatcaggaaaagcccctgtcttcccattgccaccagggatgcccggaatccgtagccaatggactgggtcagcatattcaccatgatcacccatgcctggatgggaagggtcagcatattaagccgcaaagcaagagtccctatctctatgacctccatatcctcccgccggaaggccgtaataatgggccggctgaaagcaaaggccccgatccccagcacggtcagcatgaccaccgccacctttacgcagaaccagtaagcctccaggacccggtcataccgtttcgctccaaaattaaagccgcagacaggctgaaatccctggccgaacccgatcagcgcggaattgatgaacatcataaaccgggtgacaatggacatggcggcaatggcagaatctccaaagggacctgccgcaaaatttaaggtcaccatggctgcgctcgcaagtccctgacggcagaaagagggaagccctgcgtggagaatctccccgtacatgttccatgtgggcataaagtttttaatcttaagcttaatacagccctccctgaaattacactgataaaacaataccataaagcttatgatctggcttatcatggtcgcaatggctgctcctgaaattcccattcccaatccgaaaataaaaagaggatccaggatcatgtttaaaacccctcccagtgtgattcccgccatggcaaaaaaggcatttccctgggatcttaaaatattgttcattacaaaagaggacatcataaagggcgctgcaaacaggacgtatctggcataatccattgcataaggcgctatggtctttgttgcccccagaaaataaacaagctgctctaaaaagatcaggccgaataccgtgaccaccaggccgatcagtattgccgtaaaaaacgcggtggctgccgcctggtctgcatgagtctcatcccggtttcctaaggaccgggaaatatagtttccgcttcccatcccaagggtaaagcctacggcctggatcattgccatagcggaaaacgtgactcccacggcgccggaagcgctggtacctatctggcttacaaaaaaagtatccgccatattgtaaacagaggttaccagcatgctgatgatcgtgggcaccgccaggcggggaattaaggaggaaaccggagtaccgatcatctgatcataccgttcctcctttgtcaatggttttttcatttacagctcccctttcaaggtattattcaagccccgcttccatccgggtccgatgttcatcctggggcagtcttctcaccacaatgagaaaagaaaaaaagaataagattcctttgataatgcttgaaatagtaaatgcccaccagactccgtcaagcccaagggcagtaccgcttaaaatcatggcaagagggatcctggcagaagtaaatacaacgctgaggactgagcagagaagagtctttccaaggccggagagagctcctacggtcgtcagttctatgcacatgaacatctgacaaagtccaaggatcaccagatagcgaatccccattggaatgacctctgcttcatggatgaataatccgaagatctgctccggaagaccgatcaaaagggccgtgcagaacaatccccagacaaacatgactcctgtcgccgtaaaatagcccttttttactcttccatattgtcctgctccataattttgcccgacaaaagaattaatggcggctgcaaatccatctgccgtcatccaggatatggattcgatctgcccgcctacgcgcaaaaccgccacagccgtatcaccaaacccggtcacaaacctggtcaggaccatggaaatgctggtatagattaagttttgcacggaagcaggaaatcctatctgtatcattgccttcatatgatcccaggaaactttatggaacaccttcactttatcaaacagcagccggtccttttttatgaccataaaaaacaccagggtcacaactgcctgagccataactgttgcaatggcagctcctgccaccccggaaccttttatcggacctattccaaagatcaggacaggatccagaaccatattcaaaaccaggccgataaagttagcgaacagcggcgtccggctgtcccccatggctgtcatgatcccggtaataatcacgttcagaaaggaaaatataatcaagccgcaggtgatcttcaaataaacctgggcattatgtaccacagaaatatcattcagaccaaaaaaaccgatcaatggctttgctccgaaaaacgacacagcgccataaagaaacgcaaacaaaaagcccatttggagtgcaccggaagcgaaaactgccgcgtcttccttatcaccccttccaagggagtgggctacctttacctggccgcccatttttgcaagggccacaacgccctgggaaagccagacatacatgcctcctgctcccaccgccgcaacagccggggaacctaccagcccgatccacgccatatcagtcaggctgtaagccatctgaaccagggctgtaaccatgataggaagagccagtccggtaagggaggtaaatatatgtccccttaataaatcaatttttttattcataaaataattttcacaacctttcaaaaggaccgccagtaaaatggcggccctttgactatctggattattcctttgaagaaagatattcgtgaatccctcttgctccagcacgtccggcttccatagccagaatcacggttgcagctcctgtaaccgcatctcctccggcataaacaccttccttgctggtctttcctgtagattcctcagcaatgatgcatttgcgcttgttgatatccagtccctttgttgtattggatataagcggatttggtgaggttcccaaagacatgataaccgtatccacatcaatgatgaattcagacccttctatctccacaggtcttcttctgccggaagcatccggctcaccaagctccattctgatgcatttcattccatttacccagcccttttcatccgtaaggatctctaacgggttggttaaaaggtcaaaaatgatgccttcttcttttgcgtgatgaacctcttccactcttgcaggaagctctgcctcacttcttctatagacaacatgtacctccgcaccgagacgaagggctgtcctggccgcatccatggcaacgtttccgccgcctacgactgctacctttttgcctgcaacgatgggggtatcataatcacttcggaacgccttcatcagattgcttcttgttaaatattcgttggcagagaatacgccgttggcattctctcccggaattccataaacatgggaagacctgctcctgagccgatgaatatcgcctggaagccttcttcatctaaaagctcatcaatggtcacggacttgcccacgatcacattggtctcgatcttaacgccaagctttcttacgttgtcaatttccggctgaaccacaccttcctttggaagacggaactcaggtatgccgtaggtcagtacgccgcccggctcatgaagggcttcaaaaatggtaacctcatagccaagcttcgctaagtctccggcgcaggtcagtccggaaggaccggaaccgatgacagctaccttcttgccattggtcgtttccggggcagcgggtacaaaaccgtgctctctggaccagtctgccacaaaacgctccagttttccgatggaaataggctctcccttgattccgcggatgcaccggccttcgcactggctctcctgtggacacacacggccacagactgccggaagtgcggaggactgggcaatgatcttagctgcctcttcgtgatttccgtcttccacttccttaataaagcctggaatattgatggataccggacagcctgctacacacttcgggttcttacactgaatgcagcggctggcttcttcctttgcctcttcctcattatatccaagacaaacctcttcaaagttcgtcgctcttacctttgggtcctgttctcttactggtactttctttaatacatccattactcgttacctccacacaatccgcagccgccgtgatgggtatcgccttcacgctcttttaaaactgcgcgcccttcttcagatttatacatcatctggcgcttcatggcctcgtcaaaattaaccaggtggccgtcaaactccggtccatccacgcaggcgaatttcacctctcctccaactgtgacacgacaggcgccgcacatgccggttccgtctaccataacagggtttaagctgacaacggtcggaatacccagctccttggtcacaaggcaggtgaatttcatcatgatcatcggtccgatggctacgcacacatcgtatttttttccctggttctgaaccaggtccttgattacctcagtaaccaggccctttctttcataagagccgtcatctgtggtcacatataaatttccggcctgctctctcatagcatcttccaaaattaataagtccttggtctttgcccccatgataacatccacgtcaatgccgtgttctctcatccattttacctggggataaaccggagccgttccaacacctccggccacaaataaatatttctttttcttcagttcttctatatcatcgtgcacgaattcagacgcattgcccaaaggtcccaccacgtctgcaaagctgtctcctgtctttaattcagccatcttttctgtgctggcacccactgtctgaaatacgatagtaatgctacccttctcacgatcataatcacagatggtaagaggaattctctctcctctgtcatccatcttgacaataacaaattctccaggctggcaggctttggcaatccgatgtgcttccacatccatcagatagatcttgtcagctaacatctctgcttttaaaatcttatacatcttcatcctcctaatatcttcgtgaatatacctatacaccgtccctgatagcttccccaacaatcaggtcaacagtactcgtatcatattaccatttttaaaggttactgacaacatttattcaaaaatatcgatgaaattttatggatacaggggattttctgctttttttgacaaattctgcatattaataaacccagcggatatgcctgaatatcccattaatctgcaagcagggaattgagaacgcctttttttcaaactttcctctgatacattcggaatgtatagcataaatcaaaataagtctgttcatcgctctccgccgccatttcccatgaaggatcctgatctaaattggggaaataggtgtcagcgctgtacctatagtcaatataagtcacatgggctgtattacaatatggaaggaactgctcataaatgctttgtccgcctatgataaaacaatcctcctcaggatatttgccaagctcttccattgcctctgaaaggctgtggcagacgaccgctccctttactttgtaatccggattcttagtcaacacgatgttggtccttccatagagcggctgttttccgggaaggctctccagggtctttcgacccatgacgatcacctttcccatggtttcgtcccggaacagctttttatcctccgggatggaaacaagaagctggccctgattgccgatagcccagtttttatccactgcaacgataatgttcataagtcaccccctcctttccttttattcctcttcccccatgatcagctcttttgcataaggaagggtttcgatccaccggcagagagcatgccattccaccagcttgtggctccgcctcgcaaagtagatgttgatcagtgtctcgtaatttaaggtgcatgtcctcatctggttgtaactggatggaagaagctggattaaatcataccagtcctcttttttcttggtctctatgtaacggagacggatcttttccagttccgctaccacggtttccataaagttaagtgtcccctccgtcatatggtcatggctgaaatcagtcagctcaaagggcttgctgtggatcttatgcatagtgctggtagaattggccacggtagccactttgtaagtgtcgtattctttccaccagtacatgggcgccgtaatgtccacagacaccaggatctgccggatgtatttgcggtgatcgctgccggcctttctcagccgctttgcaaggccaagatcgttgggccaaggatgtattctccttcatcattatagccgctgtccatacggtcccagctgttcatgggatttcttgcacctctgatggcattttctatgttcataacactggttctctcgcagtttaacatggtatcttcctttctgtttgtaaatttcttatttatggctccattcaattatagagcaaaatacttgtttcatccattgatttatttgtcaagaagtcttatgttgtacaatttcttttgagccgtataaatggatctgtctccattgcatagataggcaacgctacagaccataaaaaaatacggcatataagagtagccgaaaatctcagccccgataaaaacaggcgctaaaagagtgtttgtagcgcttccgaaaactgccgcataccccatggcagcaacaaattcaacaggcaatccaaggactcctgcaatggccgcccccaggcttgttcctatggcaaacagaggagtgacctctcctccctgaaaccctgccgcaatggtgatgatggtcagaatgagctttaaaatccagtcccagctactgatatgccctccatgaaagccgtctgaaattaaattcgtacccagaccggaatatcttcccattccaagaagaataaacagcattgccaaaaggctgccgattatgactgcctttataaccgggtccgggaagattttcccaagcttacttttcataactgccagaccgtgtgcaaacattgatcccaccagaccaaacaagatgcctatgataatcagtttcaccacaaagggagcatccaacggaagctttgcactaaggtcataatggaacttttccaattccagcgcctttgaaaccgtactggccgtaaaggaagcggctatggccggaaacagggcggaatattccaaggtaccagctgttaaaacctccaatgcaaaaaaacaagcggctataggcgtttcaaataaacctgcaaaacctgctgccatacctgtgactaaaaagatcctggagctgtttttcacctttattttacggccgacccagtgggaaaatgtagctccgatctgtacggctaccccttctctccctgcgcttccgccgaataaatgagtgatccaggtgcctaaaactgttaacgggatcagccgcaaagggattctgtcttcgtccccatgaccgacctgaaaaatcaatcccatcccctttatgcatttcccctcatcccagcgatacaatctgactgccaggacccctgctgcaggaagaaaaatgatcagaggaataaaatatctttcccgcaattctgtcacaaaaagcagaaccttgccaaaacctgtatccaatgctcccacaacaatgccgatcacaactccgcaaattcctaaaaccagcaattccttatactttgtcagtttttcttccagcatataccaaaacctccttgagatcatgaccacctgtaaaagatccggtcactttatattttacatttttataggaattcaaacactgacaattgggtgaatcctgcaaactaaaaaagctgacagtttctgcatatttaatcaaaatatgcagaagccatcagcaaattgcggttttgatattcctatcatgggagcgcttcattcccattccagaactattatacaggtttctcttctcctgtcaagtttttaattgttccattggaagggtatccatatcccataaaatcctgcttcctttttccgtctttttcaccaccagcttctttccgatctgttcctttagctctgtcacatgggaaatgattccgatcagccttcgttctcctgccagttcctgaaggatgcggaccgccttaagcctggattcctcatccagggaaccaaagccttcatcaatgaaaagggcatccatgctaacatttcctgcagtgctctgaatgatatctgccatgccaagggccatggcaagagccgccataaaggattctccgcctgaaagagtttttacatcccgcaccttatccgttgccatggtgtatacatccagatccaggcccacctctccctgttttccaagggtctccaaatccctgcactgaagcaaaaactggccgtctgtcatgacatccagccgtttgtttgccgcatggatcatctggttaaaatactgtctttggacgtaagtctgaaaatccaggctggcggtgcccgccattttcccattggcggtctggaataaggtatggtacagccggtacgtttcttccagctgttctctttctctccacagccgccttaaattttcagctgcctgaaacgccctgctgccaatagctgtaaccctggcttccctggcctgcaactgcctttgttcctctttaagagcttcagcctgttccttccactgctctgtttctatccgttcacgccccttggtctgctcctcatactggccgtaaacagtgcgggcctttaacagctccttttcgtaattcccggtttcctgctcccactgcctcacagtttccggggactgtcttgccctgcggtaatcctcttccccggaaaagcccagggtatccaaagcagactgaaaggcatgatacgcctgttccatggcaagcctgcgcatctcccggttttccttttccgaggccagacggccctttccttccttttccttttccgaaatgatccgaaaccgtttttccgcatgctcctctgccaataaaagctcttcctttcttttctggaagcgctccagttcttttacggctctctcctcctcagggtatggaagaagtttcttcacatgatcagcttccgccagaacagctgctttattcacctgtttctgctgccagtccttcattgctttttccttataaacttccagctcctcaagtctgccccggtccgcctttctctcttccaggatattctttaaaaggcggtctgcatccaatgcctcctgttcttccttctctgctcccctaaaaagcgtgccggcccggttcctttcttcagacaggagagctttcagctgatcctgaggaaaggacgctccaaaccatttttcttcctctccctccacaagctctttctggtggcgaaaggcttccagcgccctgacggcagcctgggcggtttgggaacgccgttcctccgcctgatttctgttcgcctttgcctgttccacctcttcctgggtgacagcgcccgcagttaactccgctttcatggggtgatgaacggaaccgcagacaggacagggcttcccctctgtcagctccctggccatgattccggcctgcaatgccagaaattcctgaaacctggcattgtaatctctttcagcctgttcatattccctttgggccaaaagagctgcttcctgggatttttctttttttattcctgctgcctcttcttccctgaccgcattctcaagggtttccattgcctgctgcctctcgaaaagttctgccttcttctgcctgatttccggcagattccctgccttcttctccgcctgctcctgccttgtctcgcttgctgaaagccgttcctttaaccgggacagctcagcttccacgttgtgaaggcatttctccgcttcctcttcctctcttttcctttcataagaagtcttttctattaccctccactgttgataaagaggtttggcctcctgcagccgggcaatgagaaccgacaattccggaacttcgccagcggatgcctccctggtttcctttgcctctttttcagcaaaagagagagcaagggttatatcttccaattcctttacaagctgccctgctctccttacagccatttcatattcctgttttttatccagatactggttttccagaccactcgccctttccgcccggacagcttcctttaaccgttccgtcagctccagccattggtccttcctgccttccaaaagatccagatgttcctttgcctgcatcaggccgtcaaaaaggcggtttacctcctgggccctgcttaatcgcccttctacctgggaaagaagcttgactttatgatcccgctccttaaaaagcttttgctccatctcccttatttcttccaggatagagcctaataagttctggatttcttctgtccttgtttccttaaaagccaaaagctcctgccatggttccctgtaaaagctttcatctaatagctccacattctcaagctcatggaagcacatcttacgattgtcttccaggctgtcataaagcaggttgttctgctcttttaatttcatctggatacggctgtagattccagtgttgaaaatcctggaaaaaatctccttccgctccctggaggaggcatgaagaagccttaaataatctccctgggcgatcatggcgatttgagaaaactggttctggtccacgcccacgatctcctggatctttaagttgatatcccgaaggctgcctgcatattccgacccatcaggcaaaagaagagaagccttagcaggaaccggaacggctgtatattccccgtttttattcttccgtttactgatccttgtataggaagggcttctggtgatttcataagcttctcccccctgagagaatttcagggaaacataggtttcctgatcttctgccccatactggctgcgcatcatggaaggctcccgcttctgtccgctggtttctccgaacagggcaaaagttacagcatcaaaaacagtggtctttcctgcacccgtatctccggtaatgaggaaaatgccatggccgatcttctcaaaatccacggtttccttttccccataggaaccaaaagcggacatggtcaactgcaatggtttcataatccctcttcctcctttgcttcctgtacgatccgctccatggctttttcttcctcttttgtcatgtctgtgcctcttaccgccttgaaaaactgcttaaatgcctccaggggcttaaggacaggcaccgtatctccctcttccagacgcttttgcctggtccgctcgttgtccacccgaagctccagcaaatggtcaaaaacctcttctaaacgctctctgacccggtaagggtcttcctcatcggtgagtgtaacgctgacaaaatcatggcggttttcttccgttgcccttttcaggatttcagataagtttcccctttcccgccttacatcctgaattccacaaagagggagaaactccagttccggctcctctccctttttccccagatttaccactgtaatggattttttatggttttcctcgctgacggaatatttatagggagtcccgcaataccggaccatggctcttcctactttctgggaaccgtgaagatggccaagggcaacgtaatcaaaggctgaaagaatgtcagaatctatccggtccaagcctcctgccatgataactgcctgctctgattcacaggtttccggatccttatttcctgctgcataaaattgatgggataaaaggatatttctctcacccgtatcaatggtttccctttccaaaacagcctttacggcgctttcgtatccctccggctggttctccggaaaaagctgccttacataccctggttttaaaaagggaagaaagtagaaatttaccgggccgttttcatccagcaataccaccttttttatgtgctcttccgggcttttgggagggaacgcagataaatggatgtgatgccgttccagaaaggctccggcataagacagacgttccggcgaatcgtggtttccggcaatgatcaggacagaaactttaggctttatcccggaaagagcttccaggaaatttccgaacatcgtataggcctccccggaaggcgccgttttatcataaatatcaccgcagatcaagactgcatccggatgatggactgccgcataatccacgatctgctttaagactgcttcctgattctcttttaggctgtaaccgattaactgttttccgatatgcagatcagacaaatgaaaaatcttcatgtttcctcttttccgcccatgttttctgggcataaaggtatgcccgcagggcgcttcctcccaaaattccttttatcttaaatgtttaaaatactcttccagcacatgcttgatataataatatcttcttgcataggaattttccacccggatcagctggaatccatgctcccggcatatggcctctttcctcttatcccgtttttttacggactcatcagccagatgttcctttccatccagttcaatggcaagcaccgggatctctctgtcaccaaattccttttcgtagaggacaaaatcaaaccgcccgttataaaacagtccgtctcccgtggtattttcttcaaacacctgggatatggcaacttctttttttacggagcacttcctgttatcgcccagtatgttctcaagggcatgatttaagctgatcaaaaatgctctttctgtctccgtactgtaaggctttacacccaaggctctggaatggacctcatcgggggtaacctcacacgctccctttgtctttacatattccaccagttcatacacatcatccttttcctctccctggtggagcctgtctaagtttttcctgtcagatacgatcacaagctgttcccttgcccttgaagtagccacattgatcagctcccggttatttttcagccactcataggtctttttcggagtctggtctgtaagggccagggaaaacaggatgatatccttttcatccccctgaaaggcatggaccgtaccgcagcttacgtcatgaattccattttcagccagcatttcgctgatgcattccttctgattggtaaaaggcgtaatgataccgattttccgatcaggaaaggctttcacatactccacgatggtttccgcttccttaggagccgtattcttgtaatccgtccggttgtccttgacatccataaagatcagaggattttccgactggaccctgctgtctatattcagccggttgttataatacttcatgttattaaactggatgatctgtttgctgcagcggtaatgatgacggagcaggatttcatcgctgacggaatcattggcaagaaaggctttgtatatggaatttttgcagtaatcgtattcatcagggaccatataccgtttctttaaaatctcattgtccttcctgtccaggaggatcaccggatttagctgctgggggtctcctaccaggagcaaattctcaccccggattatgggaaccagggaaagggctgtattacactgactggcttcatccattaccaccagatcaaaatatggctccggatgaccgattttatgggaggaaatgcaggtggaggccaccacagggaaaatgcggagaaactttttcacattttcaggatttcccagatattcattaaaggcctttacctggtctgccttgtccttcatctccacaatattccacaaatctgcattcttaggctctccaagcctttttaaatactttacggaagtaaaattaagatactttttaaactcctcttcatcatcctccagaagagccaatgcctgttggtcggtcacttctccgattttttccagcctttcctttactctctccagctgacgcccctgaaggtctgtctggaaggtcagatgcttattgactgccatcagacattcgatggcttccttttgctctcttaaagcaaggatttcctcgtgccttttaagaagagaggtcagctgcttcatgcggtttgccttatcatccctgttcttttccagagtattttcaaacaccttccactttttcacctgttcataaagctccttcatatgggaaagggcctcagaaaccttttcatcacttcccaggcggatgaccggaaaaggaatcaggccgcttcctttgtaggtaatggactgaagatccttaaccaccgtatcaatgggatgattattataggaagtaagaagcacagtcttttcattaaaaaaggccgttacaatggtgttgacgatggaataagattttccggtccctggaggcccctggacataggtcacaggatatttcactgcattatggatcgcaagaagctggtctaagttcgcctggcgctgaagcagggtgatgggataatcctttcttctgtctgcctttgcggtgaggttaccaaaaaaagctctgaccggataagtcgccctgccttcctcaaacatggtgagtatgccgccgtactcgtaatttagatccacttttacctctgattccagggcaatgagatagggcctgtcatccactcccctgcggcagagctgccgcttatgatccggtccttaatgagctcctgattcttttcaaaatcatccaaaagatcatattcggatgggtcaagaaacttacggatgctctgacactctccgctgatggtgaattctctgcatatggtgatttcctttgccggcttcagcacccgccgttttacatcaaggaaaagccgtttgtatgccagaacataaagagactcccgctgccgcccctttcctttgaccacaatgctgagcacattcatggaaagctgacgcagtttccagctcttcctgtttcccgctccggccgcttcttcctgaaagcggtttacgatctctttaaactgggcatcgcttaaaggatattctccttcagtcagacattccccatccaaatggtgaatgagggaataatcgctttggtagggtcttgtgtccagacggctgcagtccgtcagataatccagtatttttaaattcacggaggaagcaaagaggttccggtatttctcagggttttcactgatgtcctggacaaggagaggatccacttcataataggagccctccaccacagaagaagataggatggaatccacataaatacacggaaatttatccgcagtaaacaaagtcaggtgaaagccctccaccttcagggttttgttttttgggtcaatgccgtgaatggcaatccagtacttggttatctcatcctttttattcctgtattcaatgctcagccactttccctcatgaactgctctaaaaatatttctggccgtttgttccataaaaactcatcctttgctctttgtacctgtaagccgctttttttcaatcataccataattttcaggctatgaacagggagatgtaagacgattcaggacagaccaggagtaacttttggggaaatacaatacagggcagcaagtcaccctttctatagaaaaggcggctgcttacaaaaacaagccgccgcctctctcatttgcctgcataacttcaaccttcgcttactaatcggttttctagtcataatttcaatttccgcgcctttgcccgttaaccgtttcagcacaattccttcgcacaggtaaaaacagctctccatagcctttcatttccagattctctgagcacaagaatattaatgacacctttccgaacctcttttgcaacatagccgtactacattacaatcttggctaaacggttaaaactgcacccggttcctgccttcctttttagcctgataaagaagacagtcagcgctttcaagaaagctttccagttgttggcattgatatggaatcgcgcagattgcactaatgctggaagttatccttgtaatctcatcagaattactcctgggcacttccaaagcctcgattctggaacgtattttctctgcaattaataatacttcttcctgactgatttccggtatgagaacagcaaattcttcgccgccccagcggcatggtatatcagtagcacgttttaaagtatttttcaaaacatctgccacagcttttagcatgatatctccctgcctgtggccatatgtatcattgtaatttttaaagttgtccaaatccaacagcagcaatccgatggtagtttttttccgtaatgcccgctgccattcatattccatatgataatcaaacttacggcggtttgcaaggtcggtcagggcatcgtagaaactaagtttttcaatagtaagcaattgttctacgattttaatatgggtttttacacgtgcattcaccaaaactttgttaaaaggtttccgtacatagtcgaccgcacccaaacgcagtgctttttcctcatccgcatcagtatccagtcctgtgataacaataacgggaatgttctgagtggattgattttctttcaattccttcaggatatcgaacccatttgcatccggcagtatgatatcaagcaaaatcagatgaggacgaaaccgcctgaccattcgcatcgcttctttgccagtcgacacaacgttgacgtagtatgtatcctgtaaggtatccaccaacattttctggcctattattccatcctcgacaatgagtattttatatacaatttcattttccatgataatccccctatgttatcgccgaacaaaatagccagaaacagccaatgtgggaatactcataaaaacactggggcagacatttgaatgacacccatttcgtcatgtacattggcagaacttatgttttacatattttaccctgtggcatttatattgtcaagacaggcttacccttattgtacctcttttccctggaatcacgtaaaatgtccgcccgattccttcacacagactaaaaaccgctccccatacttctcatacttaaattctcccactccggataccgacagcatttcctcttttgtctttggcttcaccatacacatatgtaccaatgtcttatccgaaaaaacaatataaggcggtactttttcctccttggctatctccatacgaagtgcccgtaaggtttcaaacagctcttcatctttttctgaaaggccagcaccggatgccgctgacatcttgtttttctttgatttcttctcttcctttattttcgccgtatgctcctgttctttcgccattttcatgacaacagatccgccatccgctaaaactgcctttgacctttcggtcagttttacaatggaatactcgtcatttgtgactgtcaggaattcattcagcatcaaataattcataacctgtctaagcttataagccggcacctttgccaacgctccataataggcattctgatccatccggtaattccggattttcgcagtattagctccatgaactgtatcaataatcacattcacaccataccgctgacggcaggattccacacagcctgtcagtccctttgcaatatccgtcacatccactgtctcgaactgacttaagcagttggaacaattcccgcagtaattctctccatactccccaaaataccgcagaatgtaatccctgagacattcgtttgtaaaggagtaaaaggtcatctttttaagccgttcacggtcccgttccatgaccatccggtgtgtaaggggatccagctcctgattgtcctggttgttgtcgatgaacatctggttggtcaccacatcccggccgctgtacagcaggatgcattctcccggttctccgtctctggagcaccggcccacctcctgatagtaagattccaggttcttcggcatgttgtaatggatgacaaaccgtacattggatttatcgatccccatgccaaaggcgttggttgccaccatgatctgacttctgtcgtagataaagtcatcctggttcttccgccgctcctcatcgcttaatcctgcatgatacttggtcgcagaaaatccctcctgattcagccggtcacatacctcttccaccagcttcctggtcaggcagtaaatgattccgcactgatcgggatgacactccacatagttctttaaagtggcatacttatcctttggggactggactcccagatagagattaggtctgtcataaccggtagataccacagccggttcccggagcatgagaatatcgatgacatcctcacggacctcttttgtagcagtggccgtaaaagcgctgatgaccggacgctttggaagcctgtcaatgaaatccacgattttcaaatagctgggcctgaaatcctgtccccactgggaaacacagtgagcctcatccaccgctaccatggaaatatttgtgttcaatgcaaaatccagaaattcatccgttaccagacgctccggtgctacataaataatgggataccgcccttcccgcgcataggccagggccttataatactgacttgcagttaaagaactgttaagatatgcggcgtgaatgcctgcctgattgagagttgttacctgatctttcatgagagagatcagcggggaaataaccagtgtgattccttccatcatgagagcaggaatctgaaaacacagagactttccggaaccggttggcatgatcccaagggcatcccgtccggctaaaatgctgtcaataagaatctcctgcccttcacggaaactgtcgtaaccgaaatagtgctttaatgcttgatgtttatccatataacctttgtttctgctccttatcttttgttttttctttactgtatccattataccatttgtatttgaaatatgccacagggtttcttgaatttagagatttaaataccatatccatgcctttccttccaatacagagttttgagaaatactggcactgcacgatagaaatatatcaccagttaaacaaaatgccaatctccccttttcataccagacaaaaaaagaccgcctctgttctatctatcaaacagtatgacggcctcttgtttctaattcaagcccgttacttacaacaaaaccaatggtattacattattaatctgctcttcgatgaagttcagaaacttcggctgctccatatgatgtattcttattgaatattcagtccttttcctcataatcaaaataatcaaagtccgcatatgcatggcttcctgtaaagtcctggcagcagattcccacaaatgccccggtaaaccgctcaatctttcgctctttaaaatactcgtctgagagcttgctatattccacatatcctcccaccgtattccatgaaattccgtcaatagaataatagaatctggccatatcataataaatctctgcacgcaaatacacttttcccatatctggaatcacaatttcttcctgcagcggataagagaattggtttaaatcattaatcataaggttaataatccttcccttcatctctgcttacatacagataaatatagtttgttgtatcataaaaacaggtaagtcccgccatttgctgaaaattcccaggttcaaactccagcgaagtctccgctctgaatacaaaactctgctggcgtctggcaacaaagctttggcggaatctggagctcagtgattcatgcccatacagtcttaaataaccgcttctctctgtcagggacatcatgcttttatccaagggaatgcggagcgtctggaaattaatgtccaattcagggcgatcaaaatcatcccgtaccggagccttttccacaatgtattcttcccgtaccggggcctccacccatacctctgccgtatgcccttctctgtttaaccgcagccagccgtcatctgtccaccttaccttctgtatggcagtctcccttcccattatggaacggccctttgagggcaatggacgaccgcataaatgtaccatataccattctctatcctgagtttccaccaggtcagcatgtcctgtccgctgcaaaggcagggtacagtcataccttgaggtcatgaccggattctccgggtccgtctcgtagggtccgtcaatccgttcggcccttgccatggtaactgcatgattatagaatgtacctccttctgcggttaacagataatagattccgtttcgtttgtatagatgaggtccttctacggttccaagcccgcttcccttgtaaatcacctttctttcccctatcagtgcttttttttcagaagaatattcctgtaaaattattccctcccactgtggaaatcctacctttggaccctctctatgacttagcaatgcgttcaccagccatttacggccatcctcatcatgaaataaagatgggtctattccgcttccgtgcagatatacaggagccgaccaaggaccttctatccggctggctgtggtcaggtaattcctgcaatcccaaaaacttcctgacacattctttacatccgtataaaccagataaaaaataccctggtcataagtgagacatggcgcgtaaataccgcctgaatcaggatttccctccatatctaaaagttttagcgtatttaagggatgggctatcaatttccagtttaccagatctgttgacttatgtatttgaacccccggaaaccattcaaatgtggatgtggcgataaaatattcgtctttcacccgcacaatggacggatccggattaaatccccgaagaatcggattttctatctttctcatatgtacttatcctttcaccgcaccggcagacattgcctccggaagctttgcactcacaaacatatatccgataatgctgggaattgtcgcaaccaccaaaccggcaccgatggggccccagctggtcgcatattctcctaccatggatatgattcccaccgtaagggtctttaaaccagccttgttaataaaggtatttgcaaacatcaattcattccatgccgtaagataggtaaaaatggaaaccgtagccaaagccggcttcaccatgggaagcatgatttggacaaatgtctgataaacattgcatccgtcaatcactgctgcctcctccatttctaatggtattgtcttaaaaaatatggtcagtacattgattgccagaggaatggcaaatcctacgtacggtaagatcagtgacaaccttgtattcaggattcccaccttgctgaaattcaaaaataaaggcagcagggaagcatggaccggaatcatcattcccatcgtaataaatagaagaaatgcattgcttagcccccacttgagccgtgcaatggcataggaggccattgtggatacaataatcgtaatgataatcgtggagccggtgataattacactgtttatcaaataaagtcccacctttgctccgccaattgccaccaaataattattaaatacccatggggacggcaggccaagtacatttcctccgaatatctgtgtattatcctttaaagaaaacataatcagccacaagaggggaaatatttggataactgcatatatgcacagaatcagaaataccattttctttgcgattcctgattgtttcacttgcttcatggtgtactcctctctaataggtatactgctttggcttccagagattaattaacacggtgaaaaccagacattcaattacaataaaaatagccatggaactcccatatccataaagatttttcttgaaaatatttgtatacattaacgtacttgcaacttccgtagcatggtttggaccacctccggtcagcacatagataaggtcaaatattttcagagacccgatcactgcaagcaccatggaagtcttaatcgttggaagaatcagcggtatgataattctgactgctgtctggaatctggtagctccatcaatctcagccgcctcaaagatatcctggggaatccgttttacccctgaataaatcaaaagcatatgatagccaatatactgccagatcactactacaaaggcacacagcagagcagtgtccggatttccaagccatgcaactgccttattcagaaaacccagcttcattccaatggaattaagcatgccataggtgggattataaatcattccccagagctgccctaaaaccaccgaggacagaagtaccggtacaaaaaagactgtcctgaaaaatccttctcctttcactccccttgccagtataattgccagtgccgtcgcaggtaccaattccccaatgactgaaagacctgccagtaaaagggaattcttaagggcagctacaaatccatccgtattatgtataaacagggatttatagttatccagccccacaaacatctttttcgtaatcccatcccattctgtcaagctgtaataaaaagacattccaatggatgtaactaccacaaacaagaatatcaacagtgatgggaatataaatatgaggattgcttttttattactcaacatcttattcatggttatctcctttttgaaagagcagtccatgaaaaggactgctctcatcatttcttaaacttactgcaaaaaggttttatgcttttctataaactcgtctggagttattgtcttcataaaggtttctgtcaccgtttccagatggttggtcgctttttcacttgtcaaagcagtatcccaccacaaggaaaggccggtacagttttgatacaggttataggcatctaccagcagctgattttcaatcgtgcttgtatccacctggctcttccatgtgggcaggcctgccccgctggtaaatacgttctttgaaaagctctcacacataaacttatatacttccactactttttccggatttttcgtctcgctgtttatcataaaagtctggtcagcacccccaggaattcattgggatcacctttcccccttccaccacagggaagttcagtgcaacaatatcgtcttttataggagagtcaaagatattggcgcataaccagcttccgttatagtacatgggcatcccgcctgacaaaaacactgcctgggattcatccttgctgattgcaatggcaccttctgtaaacgcccctgcatctatcattccctgatacagctctacagattttttgatctccggagtgtcaatggttgcttcaccatttaccacttgattgacataatcagttcctgcttcccgcatggtcagggcgtttaaatacatggctgcagtccaggtatccttagcacctacgcacatgggagtgattcccttgtctttaaatacgttgattgcattcatcaattcatcataggttgccggcaattccagtcctgcctcatcaaacatggatttattacaatacaacagtccaatgttcacgcgggttggcagtccatacagcttgccatcgtatataaaattattggtagtgccttctattatctttgcttttgtctcatcatccatgtaatcatccagacacatcacctttcctgcatccacaaatgctttagaaaagccgcctccccagctgtagaaaatgtccggcgcttcaccgcctgctatagctgttttaattttcgtcttatatgcgtctccggaatccgccacagcatcaatgacaaagtccacctccggaaacttttcctccatttctgccaaggtcttcttaaagctttccgcagttcctccgtttccttcgggccatacatgccacaaggaaatctttatcttatcgccagactgggtttcttttcctgcaacactttccggcgtcttcccggaagaagatcctccacaccctgcaagccccattgccatagaagccgccaaaatcattgccagtactcttttcaacttcattttccttacctcccgtaaatttcatttgtgctttgtctgctatgaaaacagtatagctgccatttcctttattttaaactgaataaaatgacctgttatcccgaatatttttactttttctgtatggattccttgtctttctcattttctttccagaattttttacatttacctgctttttttaccattttccaagcatcttgcttttaaagaatctcttttgctataatatcattatatcattgcgaaaaaggagtaccggcatggcagctttggtttcaatcattaagcaccactatcataaaaataagctacacacgaatatgctcattatatttatgatgctgttcatccttattaccataccttctatgtttctggtcaggcattttaaccagaaaaatacacaggaacaaatggaccagatatcacttaataacttatccctaagcgatgccaacctcacacagaccctgaatggagccggaaagatttccacctctctgctctcaaacaatgtactccaaagctttctcagaaggccggctaaaatgcacgatcccagtgagattactctgttagaaaacacactttacaacgcatgtgccacttcagcaaatcatttatctgcgtacctttatacagctgatggtttttgttatttttcagattccaacggtaaaaaaaaacttgggaagacctctgtcaatcaagcagatatctatcttcaaatagaggaggctgacggaaaaaccgtatacttggactcctcagggatttatccggatgtacagggaatctccgcagcaaggattatcaaaaatctggacacattaaagcctatgggaatcctggttatcaacattcccagtaaagatcttgcttcggcttttccggacagcaccgtaagcagaggttttattctcagcaaagagaatatccccgttctcagcagtttatctttttcttttgattatacaacacttataccgccagagaatcatttgtcttatatcctgccggtcaaagaaaagaatgcagatggtttcctttattacaaagctttggacaattatccgtttttcataggtatctttcaggacttccgttccatgtcagaggtggggttcagcacctttctcatgatcctgttacttctgatgattaattttgttttaatccttataggaatttacatggtatctgtttcccttaccaggccaattactgctttggctgaaaaaatacggcagcttcacagaaaggaattcagaaaaatccacacagatttcgagtccagcaatgaaatcggataccttgcctgctcctataacgaaatgacggttgaaatccaggaacttttaaagaaggagcttgctgctgaaaagcaccgcaggcatttggaattaagcctgctgcaggcccagtttaagccccattttctttataatacaattgacagcgcaaggatattatgcctctccggagacacaaaggatgcacaatctctgctgaaagccatgggaatttattatcagacaatactcagcaaaggcatggaccttatttccatagaccatgagctgaacagcatcaaacaatacgagacgatcttatcctttcaggataatcatgattttctcattcaatacgatgtgtccgaggaagtacggccccttcctatattgaagttcatcctgcagcccttggtggaaaactgtatcaagcatggtctctatggattggatgagggaatcatcactattacttgccggttttccggggaagatattttatatctctctgtggaagacaatggaagggggatggaaccggaactcgtccggcaaattaccgggaaaacttatctcagtccttcccgaagttttggacttgctgccactctggaacggatgcagcttttttacggacaggactgctcgtatgccattgacagtacacggaaccagggaacccgtatctcgtttacaatcatccatttttccagccacgcatacaaggagaatccgctatgagaaaccgattaaaacttctgattgttgatgacgaaaagcatgtccgcagcctgttaaaatactgcattgactggcagtctctcggaattgagatatgcggggaatgtacctgtgcggaagaggggctgcaattagtagaggaactgcagcccaatataatattttctgatatctgtatgaattttatggatgggatagaattcagccagaaagtcagggaggcctatccctacattaagattgtcctcctctccggccacagcgactttaactatgcttcccgcggaattgacgcaggtgtatccgcttatctgctgaagcctattgatgaggaaaagattttaactgtcatacaaaaactaaaggaagatattttccatgaacaggatagagataatgaattagaaaaactgaaggaatactttactgacagccgggactttttaatagaaaataatttgaatgcacttatgcttccgtctgctgatatcgggagcattatccggcggctccagtttttatctgttgatttcgcaaatccgtattttcaggtggccattgtctcactttcttccgaggatattccaggcaataagaacagtgaaaatccttacctgctttccatggaatgcgcccggatcctaagtaaggaactgaaaaaacacgaaaatgtgtaccttttttttgattataatcacaccaacgttattctctccaacgccccggctatgcccctttccagcacactggagcatgtgaaagtcattttactggaacagcttccctgcagcgttacaataggaatcggtaatgctgtttccactttatcgcaaatacgcaattcctatcaaaatgcggtggaagctgttaaataccgcacggtctcaggtaaaaaccaggtaattttatatgactatattaaaactgaaaagcaaaattcctcctttcatttagaagatgccattgcatccatactggaagccgttaaatcagaagatctgcctgcttccattgcgctgataaaccactgtatcaccaaccagattacggatgattatacggatatcattccaatccgtgtaacagtttcaaccatcataaatcatttatctgatatgctgattcaatccggactccgtggtactgatgccttccgctattccctggctgcatatgaacgcctattccgcctggaaactgcagcggaattggaaaatatggtacataatttaatccgtgcaattattgagaccttttcctccatacgaactgagaaaaataccaacaccatccatgccattcttcgatatatggaaaataattttgaaaatccggacttaagccttagctctgtggcgggcagattctatctgaatgccagctatttaagccgtctgttcaaggttgaaacagataccacctttacaaaatatctgacagaattaaggctgaaaaaagctgctgagctgctattgaccacgcagcttcgctcatatgaaatcagcgaaaaggttgggttccgcgatccaaaatatttcagcagctgtttcaggaaacattataatatggccagcaacagttaccgaatcaacgcaagtcaggaactcttgtcaaagaaagaagaaactttttttgagtctgaataatataaaactctggcttttagaaaaagatcatactataatgacttatgcatgatacggtatcatgtataagtcatttactacataggagaaaaactttgaaaactaacatcggattgtacctggctctgctttttggcgtcttttccctttccacctccgcaatttttgtgcgtctggccaatgccccctctgccataacagcatttttccggttgttttttgccgctctgatcctcttgccatttttactgagcagcaaacaaaacaaacgtcagctgctttctctatcaaaaaaacaatggacgtttgggattttgtcaggacttcttttatccgcccattatatgctgtggtttgaatccctgcggcatacgtcagtggccagttcaacggtcattgtaaccttgcagccccttttctccattgccatcggatatgtgtttctaaaagaacgattccacaagctggcaatcgggggatgtgtgatcgccattatgggctgctttatgatcggatggggagattttcaaattagctcccaggctctgtttggggatttattggcgttattggcggcgagtattatcagcttgtattttttcatagggcaggcagtaagaaaggaattatctgctgtcccctattctgtcataagctatttaagcagttccgcgtttttaggatgctatgccataatcgaaggcaatccttttaccggctattccggagctacctggatggcgtttgggggtctggcgctgatttcaacggtattcggacaatttatttttaactggcttttaaagtggattcctgcaacagtgatatccatgagcattttaggagaaaccattggcacatgtattctggcctattttattttaaatgaagcaatttcccttcagcagggtatcggaatagccaccattatgtctgggcttgtgctctttttcctcagcccccaatacataggaaccagtgacatattgcagcaattataaacaatgaaatgtaatggaagaaggaaatattaattgcagccgaatatatggacaacagacattcagccgcaattcagcttcttccattttctgaccttacttctaaaggatttgaaaggtgcaaccgtgttgatgtggatccatttccagactgcccagctggaaggtgttgaagaagcccattttctgactccgggctgaaaaagctgggcatccgtatattgttctgtcagctctatgatcttttgtaccgcttcctgaaacatggtgcataattcctgcaaactgtatttctcatattgcctgtaaaagctctcatataatccgccaagattgttccatttataatcaggatgcggggttatcactgtatttccctgctgctcctcatcctcccaataaagaaggaggttaagccagcccaattgataagcaaccatctgcgccggagttctgtccacaccgtcgatcagtttgtccttatcgtcctccttaatatgagagaattcatcaatgaataattttgcccggtttgaaatttcatccatcaattccttcttatctttatattccgtcatatggcgctgccctcctaatttgagttttatttgctgttaccggcgatccatgtctgcacaagcgccaggcaccattgcctcaagtcctttgatatccctgattgaatcaatgattttcctgttaatatctttcactcccattctccctgtgaaaatacgagcattaatcatgaagctatattatgttccgtttcctttcttgggaatacccaatttttataaagggatgcctgctggttgaattttgaatgaaaataacaactatgttatgctgattttgtttatagaaatattgtaccgttattccttaaaaaaggcaaagaaaaccagtgatataaatatatttcttgaaatttacccccgtctttgctataataacccgagggaatgaagttctccccgtgctgattatagccgaaccgcttattaagctgatgacttctgcgattattttattgcagaagtgtcggcttttttacatttctgcacaaaggaggaaatatatgcttttcagtcttgcaatgatggttctctgcggtatgatattgagcggaaccatgcagaaactaaaactccccggccttgttggcatgcttctcaccggtattgtgctagggccgtatgcgctgaatctaatcgcgccggagctgttgaatgtttccgctgatttaaggcaaattgccctgatcgtaattctcacaagggcagggctggcgctggatattaaggatttgaaaaaggtcggccgtcctgcaattcttatgtgctttattccggcaagttttgaaatagccgccactactgtttttgcacctatgttctttcctatttcccatttggaagcggctatcatgggaacggtgctgggcgcggtctccccggcggttatcgttcctaaaatgttaaagctgatggaaaacggctacggcagggcaaaaagtattccgcagcttattatggccggagcgtccgttgatgacatttatgtcattgtcctttttacatcatttatgggtatgtatgagggaagcagctttgatgccataagccttcttaaaatacccgctgccattgtgacaggcttgttggtgggcattttactgggtcttgctctggtgaaggtgtttcaaaaaatccacatgcgagataccgccaagattttgattttattaagcactgcgttccttctggtttctcttgaaacagccataaaagcctatgtgcctatgtccggtttgctggctgtcatggctttaggcggcaccctcctgaagcagtacgatattttagcaaagcgcctgtcaggcaagttttctaaaatctgggttgccgcggaattgatgctgttcatattggtgggtgcaacagtggacataagctatgcggcaaaggctggatttatagccgtcgctctcatctttatcgctttgctgatacggatatgcggcgtatttatctgccttgccaaaactcccataagcgcaaaggaacgtctgttttgtgccattgcctatttgcccaaggcaactgtgcaggcggcaatcggcgggcttcctttggcggcaggcgttggggccggtaatacgattctgacggttgctgttttggcaatcctgatcacagctccccttggggcgatcggcgtggatgcaacctataaaaggctgcttataagaagcggcggcaatgccaggacctttctcccgccaaacagccatgaggccgtacccacatatgaggatattccactataatcaaacaggatctcacagcttaaccacatgcccggaactgggatagggcatgtggtttttctgttttcagggaaggcagaagcctaacatgatttccagcaagagcatagctgtaaaacacaaacaaacgttttccttgatcattgaacaccagttattcttccggaatgtcttccggaaagataaccatatccctaaaactcttaaactgtttttcaatatctggattttggataaaaaactccatcagaacctttatttccaatacagtcaaatcacccagcatgtgttcaaccatctctgcttcttccaaaggccgctgacttttaagcatgataaaaaaatgctccaaagtattatgacgttccagaagataacagcccgttactcttccctcatcagtcagcaggatgttctcaaatcgatcgtaccttaaataacccagctgaacaagcttggacaccatctttgatgcagacggagggcggacgtgcagacgttctgaaagcttgtttatgcggatacagctttcttccagacataaccggtatgccatttctaaataatcctcaagagcaggcgtaagtctgctctcattttgttttttcagttcatatccccgaatagtacggaattcctgaggcggaaattggttcattgccattcatcctctgtttttcagattttatatagtgtattcgtaacactttccacttaggtctcataaattagccaaaggaaacattatttcccacccctaacggatccggatgatgaaatgattaatttcatatgcaaaacacttgcatttttacgtgtttaggcatataatataattaaatttaggtatgcctaaatatataaaacaaacaacacaacaggagaaaaaatatggatgcttatacaaaacagctttttcgccgcaagatacctcctttaatagtaatcgccctcatcctgctgattggatggcttaggaaaatttttgcggtataaaagaatctcatacactttcaaacaatattcttacccaagctgatggctgggcttatatatctaaaacggaggaagataaaatgacaccaaacaaagaagattatttaaaggccatttataaactgggcggaatggaagaactggtaaacaataagcagattgcggaagctttgcagatcgccccggcttctgtgacggaaatgctgggaaagctgaagaaggaggggctgatccattatgagccttacaaaggttcatgcctgacgcctgagggaattaaagttgccatttccctggtacggggacaccgtctctgggaggttttcctgatgcgtcatctcggctattcctggagcgaggcacatgaagacgcggagctgctggaacacattaccccttcacgcctgacggcccggctggatcagtttttaaattacccggcctattgtccccacggaagcgcaattccccatgctgacggccaaatagaccgtgctcccctggtgaccttaaacttactttcctccggtgcagcttcccatatccggcgtgtaaaggaagaaaaagaactgctggactatctgcaggaaagcggaattaccattggaagctccgtacgcattatagaagccgcaccatacgaaggaccgctgacccttgacctggaaggcaagtgcgttcaaatcagttataaggccgcctgtcagatctatgtagacgagacagagaggctgtgacatcaaatataattttaggaggtttcttatgaatcaaaaaaccaaaggccttttgggcacgatcctgagtcttacattatttcttacggcttgttctgctccggcagtaaaccaagactcatcaaaagataaattaaacattgttgctaccactaccatgctggctgatctgtctacagtcatcggcggagaccgggtttcagtaaacggtctgatgggaccaggtattgatccgcacttatatcaggccagcgcaggagatgtttccctgatgcagaaagcggatgtggtggtatataacggcctgcatctggaaggaaaaatgggagaaatatttgagaacctgtccagtcaggggccggcagtcatctgcattgaaaaaggcttagacgaatccatgcttcttgcgtgggaagatgacagctctatccatgatcctcatatctggtttgacgtttctctgtgggaggatgcagctaaaaccgttgcaaagggattagccgaagccgatcccaatggaaaagctgattatgaggcaaatctggacgcctacttaaaagagcttaatgagacggatcaatacatccgcggcagggctgccgaactgccggaagcacagcgcgtgctggtgactgctcacgatgcgttccaatactttggcaaagcctatggatttgaagtacggggactgcagggtatcagcactgatgcagaagcaggtacagccgatgtaagcgatctggcaggtttcattgtagaacggcagatcaaggctattttcgtagaatcttccgtgcccccgaaaaccattgaagcgctgcaggctgcggtaaaagcaaagggctttgatgtttccatcggcggggagctttattccgactccctgggtgatgcccagtctggagctgatacttacatcctgaccgtcaaagctaatattgacacaattgtggatgccttaaagtgacaggagggaatcatatggaaagacaacaaaactatgcggtggaggtagaggatttgaccgtagcctatgatgcaaagcctgttctttgggatattgatttaaaaatcccaaagggaaagctgatggcggtggtcggtcccaacggagccggcaaaacgaccttgatcaaagccatgctggggctcttaaaacctgtgaccggggctgtccggtttctggatgggaacgacgatctgcgcaccttgaaaaaccgcatcggctatgttccccaaagcggaagcgtggactgggatttcccggccacagtgcaggatgtagtgctcatgggctgctacggcaagctgggctggatccgccgtccccgtaaatcggatgtggagctggcaaaacagatgctggcaaaggtaggtatggaggagtacggtggccgccagatcagccagctttccggcggccagcagcagcgggttttcctggcccgtgccctggcacaggaagcagaggtttactttatggatgaaccttttaagggggtagacgctcagacggaacgggctattgtggcactgctgaaggaactgaaggagcagaataagaccgtggttgtggtccatcacgatctgcaaacggtacccgattactttgactgggttaccctgatcaatctgcgcgtggttgcctgtgggcctgtggatgaagtattccacgaagacaatttaaaaaagacctaccacagctccggtgcgcttttaaggggtgtgatgtgatgtttcgcagtattatttctttattttccgactatacgttccagacagtagctctgggttccgccctgctaggactgatcagcggagtgctcggcagctttgcagtacttcgcaagcaaagcctgctgggagacggggtatcccactccgcccttcccggggttgtgatggcctttgtactcctgggcagcaaaaatacggaggttctgctgctgggcgcccttgtttccggtttactggcaacactgtttattgtcagcattgtgcggcatacccgcgtgaagtttgacagtgcgctggctcttgtaatgtcggtattctttggacttggcctggtgctgctcacctacgtgcagaagattcccaactctaatcaggcaggcttaaagcgcttcatcttcgggcaggcgtccacgcttttacagcgggatatcattctgatgatgatctgcggccttatattgctcgcactggtactgctgttctggaaggaatttaagcttttcacttttgacagcgactttgcccagagccttgggttttccccaaagaagctgaatctcctgctgtcatttatgatcgtactggcaatcattatcggattgcagacagttggcgttattctcatgagcgccatgctgattacccctgcggttgccgcacgccagtggaccaataagctgtgggtcatggtggttttatcggcgcttttcggtgctgtatccggcgttgcaggaacggcggccagttctcttgttccaaagctgcccacaggcccggctatcgtggtttgtgtcagttccatcgtaatcatcagcgttttgtttgctcctgggcggggtgtcctgcacagagtatatcagcgcagaaaaaataaggttctatataagctggaaggaggtgtgccggatggcaccgcaaattgaaattcaaatcatagccgttattgttgctgtggcctgtgctctgcccggaacgtttctggtgcttcggaaaatgtcaatgatgtccgattccattacccatacgattctgttgggaattgtactcgcatttttcggcacccatgatctctcctcccctttgctgattgtgggagccgcactgatgggagtggtgaccgtgtggctgacggaattgctgagccggacgcggctgctggcggaagacgccgccatcggagtggtgtttcctctgctcttttccatagccattattctgattacccgttatgccggatcggttcatctggatactgattccgtacttttgggagagctggcttttgctccttttgaccgtatggtcataggcggcacggatataggcgcaaaagcgatttatacaacagggatcctgctgctgatcaatctggcggcaattattattttctttaaagaactgaaggtcgcaacctttgatcccatgctgtccgctgtgctgggcttttcaccggccttggtacattacgggctgatgaccctggtatctctcaccacagtgggagcatttcaggcagttggatccgtattggtggtggcatttatgatcggccctccggtgacggcttacttactgacggacgatctcaaacaaatgctgattttaagcgggatcatcggagccgtcaacggaatcctggggtatcaggcagctgctctgttggatgtgtccattgcaggcagcatggccgtggtaaccggattggtcttcttccttgtgtttgtttttgccccacgcagaggactgatccgttcactgcttaaacgcagaaatcagaaactggaatttgctaaggcgacactgctctttcacctttctaatcatgaaaacagtgcggaagaaaattcggaggcaggcgttgacaccataaagtcccacctgcactggaccggtgagtttacatcaaaaatcatcaaatccttagaacgggaggactgcgtccagctatccggcggtctggtgaaactgacggctgaaggacgttacgccattatgcgtaactatatcacgcttttctcacgatgaaactctttataaagatacagaccctatccttagaatggaagggtctgtatctttattatttaatttgggtctttaatctctaaagcctttaaatacaggtttatctgaagcgtatataactgcttaatcatgcattttcttatcttttaatgcagcagctattgcctgcactgccgcatacataactcccgcacaaggccagatgatccacgtcctgctccaatttcccgtataaaaactgatgcccagatataccgcagtaatggtacaccaatatatggcaggaaggtgttctgactgcttttttccagcttcttctctgccgtataatccccctcctgcagaagcatctgaaaacagccctttttctctcctgccgccatgaataaaaatacggcacaagccactatgatcaaaataaaatctacacacaaaacataaacaaagtccgaactgcttaatgcaacagctgccatcaatggcaaggcgcagataatacataggaaaacacctgccatggtacatattctataggttccttcatactctgccatccgtttccgtacgaccccttccacaccatattccagacgaaaaacttctttctctaaaaattgataaggttccgttttcattccatgcattacaaaaaacactgtggcaattccaacaatcagaagcaatatgaccagtccaagtcctcctgccacgtttccactgatacttttatcttttaattcggataatcctccaagaaaaatcagtgcagcaggagacagaatgtaagctgctgcagccaaagccacctttttcgcccagcggattttgatctccatgaattcattggccatttcaagggtgacccttttttgcacctcatcagaatcggattccatgataatagatgcaggagctgtctctatctcttcttttaataaataatctgtgctgacaccaaatacctggctcagctttaaaattcgttctaaatcaggaattgaagatccggattcccacttggatactgactgccgtgatacgcccatctggtaagcaagctcctcctgggaccagccggcctttttgcgcaatgcaataattttttctgctaatatcacaatgtaccatcctctcaaaatttatttatgccattcattcttcaagtgcaggaaagaagtagctatgtacacctggtgatgtatgactcttgcattatagaatatttttaggttgacaaccaccaattgcgttgtataatttgtcaaccagcggttgcaaatgatactttgttatattattaacagtttttatcacataaacgtgaggaaacagcagaaaatttccagagaggaattcaaggaatattggatactgcagcaaaatccagctgtcagatccgtaatctgctgcttttctgctcaaagaaatgggtatagtttccgttccaaatctccaccctgggaaatgtctccggccttacagggccctttttcttcagaaggagccactcgctgtatgccatcatcagagcgcccgctcccttctgttcatctgccaccaccggctctttaagatagtatgccctgcttccgtccctggcccggttgttctccggccccaggcctgcacccttgcacattccggtcagctgcaggcgccctccggaaagggcaaacttttctgtctcaacagccaggaatatctcctctcccttaataagataggggattccggtaaaactccaagacggactcctttaaaaagggcataggcaaacatgagagaggcggaagtctccagataatttccctccagaccgggcagcgccgtaagctggtaaaacagtccggattccctgtcctgatagggaagcagcccttccactgcctctgaaaaaagcgctgaaagccgtttcttgaatttttcttctccggcaaacagttccagacagtctgctaatgccatcaagtaccagcccatggctctggaccagaagttttctgacagtccggtctgcttatctgcccagaacatctgctttttttcatcaaaggcgtgataatacaacttcttttcctcatcaaagagcgtccttctggcattgtcaaactgcagaagaatgtcctcatacccctctccgtttccaaaccgcctctcataggtaagataatagggcattgccatatacaggccgtccagccacacctgataagggtagatctttttgtgccagaagcttccgctttctgttctgggctgatgggtcagctgattacgcagtcttgccatggcggacctgtattttggcagggaggttttctcatacagaagaaacaggacaagtccggcgggtattctgtccagattgtactcttcttcctcgtagccctttatctccccgttttcactgacgtagcggtccacataatttttgatacagtcataataaaattcttcgcctgaagcatggtacaatttctcggctccgatgagaacacagccatcctcataattccagaagtttctgtccagccggttaaattctcccatataattcataatgtaacgttccagcagcatgtttgtctccttctatacttataaagccggcggtttccaccgccggcagcgtatttaattctttaatgtccaattggcaaaggaatattcgcccctgtaattggaacagttataatggggatatttttcaggcgtgtactctctgtcagtaacaggtgaaagactgtcctgagtgtagatgtacatccggctggcatcccacagcacaatttcatcccgcgcatcccctgttaaattgatcacctctgcacacagctccggatgtccgtcgtcagggaacgaaaccactacatccccctctccgtccagcattcctccaaagcgggtgctgccatttaggagaatcagctctgtgccgtctccctgccagttgaccggcgctattacattgccgttggagccgggctccatatgccacagctcccttcccttgcagtcatacagatagataattccctgatattcccaataagtggtggtacagatctccagccctttttgtttcgggcagtaattggccgcactgatcctctgtccgtgtccgtttagatcacgaagcctgatatttccctgcttgtccaccagcataaagccttcccagccggataccatggcaatcatttcatcctcatccgggtcaaactttcctacaatgatctcgtccgtatgatcgacttctacgggaagggtccaaatgagctttccatcgcttccgatcatattatagcagctgaatatttcgtcttttccatctttgttaaaatcataactaaatggaaagtggccggtatttttgtaattgaatttccagagcaggtttaaatctttgtcatatacccagaggcgggaataccggtccttaatcagaatgtccgaaggtctgtcgtttccagatacgttaacgatgcggactgcatccacattcagacggtcaaaggcgtgcttttgaaattcaattccatacagctcgctttccggaatgtcgtttttcggagtatgaatccacttcttcacttccccggtcctgccgtcaaggatcatcagtttaaaatctctggccatgatcacctcatcactgccgtcatgatcaatatcatagagctggaagggaagatctgctgttacattctggttttccttccagtctgagggctcacccacctgccagagaatctgtccggtttctacgctgacagctgtaaggcagctgatattggaataccggtccttatgcacccgtttctgatgctgtgccataacaaaataccattcatttcctccgcacagatgaccgaaccgcagctgtcttgctgcaccgaaatttttcaaatcaatcaccttatgtagcctgggctgggcataacggcttttcttctctgccaccctcttttcatcctgcctcttctcctttgtccattcacggaaggatttgtcatctgtttttacaaccacatcggtaaactgtgccggcatgtagctggacaaggcgatcttaccccaggaatagctgtcatcctgggcagtcagcaccgtctccccgttgattctgcaggtaaaacggctgcccctgcactctacctcaagatgataatactcatctccattaaattcaaaggtcctgctgaccagcagcatacgctcctttttatggattttccatagctgggcctcacctgcgtgaagaaagaacccatagttcatcagagaggtctgataacggaaaacaagccctgcctcctctttggtgctgagaggacgcatacgcacactggcggtataatctctccatctcacatcccctgctgtcagaaggggacttacattttttgtaagaggatttcttacgcgcatctgctctatgtatctggttccgtccatttccgtgatcagccagctgggacctctgtaattggcatttacaatgggatcataccattgaccggtataaccctccaccggatagtagtgatactctcccatggcggtatgggcatggtcataaggaaacgagcccaggggaaatgaggtgaaatcatcctgaaataatatattgtccatttttatatactccttattctgtgcagattgtcccatccgcaagccgctgcatctctctactgctgtgctttatatgccgcctgctcctttgtcaggaagtccgcccatttatttaagcagtcctgagatgtcatttctcccagcataactgcctggaaatctgtagtcatctctccgtttataaaagaaaaataggaagtcagccagtagggattctggatctgtacaaaattcttatcctgaataatgtccatacacaactgcatggtactgttatccttaaaccagtctgttttatagcagtctgtattggtggggaccttggacataagctggtccatttcattcatattatcggcggagcacaaatactggatcagctccatggcaccgctgtaatctgcgtcatcacctttgttgcatacggagaaaatattaggctgcatggcagaggtaaagtaccttcctttgtcattggtcagggctttggctattccgtaattcccctcgccaagattctccctgtggctcttctcggaggaggaattatgcattacataaagggccgttcctgcaccgaactctgctaccatctcattgaaaccgttgttaacgctgtctcctgataccagaccgtttttgtaaatatctacataggcatccatggcttcagcaaatgcaggatcccccaggatgcactgaccgctctcatcaaagtaagagccctcatagcccagaccgtccgtataggtaaagagccagcccagcaggttatcataaggcttgtttccccttaaactgaagaaataatttccgttgtccttgtctgcatacttttcacagtcttccagaaaatccttctgggtcagaggcacttcaatccccttctccttaaaagcggcagcattgtaccaggaaagatcctgattatatccatagggaacaccgtacaaattctctcctcctgccaggtcttttaaggtggtgatcagagaaggtacgattttacccgaatcctcccatgcggcaaactctgtctgaatgggatgcagggcctccatagccgcataggtcattacattggagaatccaaggctcaccacatccggcatggtgcctgtggcaacagccgttgcaaatgcatcagggaaatccttgtttgcaaaaccggtgtaaacaaattcataggtatcctgggcagcattcaaatccttgaagattccttcaaacataatggaagactgctcatcagcggcatgataccagaattcaattttctgcttttcaccgcttttttttgcctctgtagcctgggcctctgccgtggtgccgtcgctgctctctgccggtgacggctgactctgcgcctctttttcagttccccggcaacctcccaaactcccggcaaggagcgccgccgccatgatccatgcaattcgttttttcatatttctttcctcctaaaatattttaataaaaacatagaactatccttttacagccccgctggtggaccctcctgccagattcttctgaataaacgcaaacaagagcagtgcgggaaccagggcaaatacacaggcggcagcaattccgccgtagttggtattggcctccccctggaaaatactcagcgccagtgggatggtatatttctcctttctggtgataaaagccgtggcatatacataaacgttccaggaattgataaatgcataggccccggtagccacgatacttggcttcatggcagggagaagtattttaaatacagcctgaaggagattgcagccgtctacctgggctgcctcctccagggttctaggaatggcattatagtatcccatcatcataaacatgcagtaaggaagattggtgcaggagcacacaataatcagagaccgcagatcattgatcagcttcagctgattcatggtctgaaacaggggaatcatcagcactaccgcaggaaacatctgcgtgcacaaaagcagaatatacacaaaggtttttcccttaaacttataacgtgacatggcatagcctccgattaaagccatgacgctgaccagagcggtcacggacacagacacgataaagctgtttaagaaataacgctcaaaatgcagtttctgaaacaggttaataaaattatcgtaggtgatgttccgcggccagtaagtcaggggcttggcaaatacctctgtgctggtttttaatgcggttatcaaaatccagtaaaagggagccagggtgattatcataaaaaagcttaagggcagcaccagaaacaggatctttttaaagagctttttcgttttaatatccatcagtacatctcctccttccccagtttccctatatgaatatatgaaaatgctataatcatcataatcaggcttgcaactgcagccaaagccgatgcatatccgtaattatagtccagcttgaatttctgcatgatgtaaagaggcatggtcatggtggcattgttaggccctcctcctgtcatcgtattgattaagtcaacggcattaaaagtccatatggatcttagaagtgtggtgatcacaatcgtatcccggatcatgggtatggtaatccggaacagagtcacaacagaattggccccgtcaattctggctgattcataaatgtcatctgatatgcctgacagcgcagacaaatagctgatggtaaaaaatggtatgcctctccatacatttgcaatgataaccgcagtcatggcccggcccgagtcggaaaaccaggaaatattcttatgtatgatccccagtttcaaaagcaggtcattcagcactccgaaagtctccccatatatgagggaccagataatggctaccataactcccgccaccgcccatggcgacagcaccagcgcccggtacagtccctgcctttgaatttttggtttaataagtaagccagccagaaacccagcacagtctgagccagcacactgacaaacacccatgtgactgaatttctgattgcttttaaaaatactttgtcttcagtaaatacggaaataaaattatccaaaccgataaatttcctgttcctgggctttaaaagctcatattcctgcacgctcataagaaaaacgttaatcataggccaaagcagaaacagggatacaaagatcagtatcggtgccagcagaatataaggaactgcctgccttttgtaatagagatatttctctcttcccgccttttttttcatattatcctctcctgtcacatgttctcctgcaaatagatttccctggttaaaagcagtccgtccttttccagcttttccgtattcatccggaggggaattccaacaatgccatcctgccagtaaaaacggttctcttctcttacaggaggaaacatggtatactccatcaccggcgcgttgatcggttcatggaattcgatccgctcctgatcattgtaaaggcagccaaaaagcagattcgtgtaaagtctgccgccggaagaaaaggttttatgattttccctgcacatatcccttatcctcagtaaatcgtccatcctggtcattctccccagagacggctgcaaatgatcaactcccttttctatataggtttcatatgcataggaaatccgcatggactcaccaaaggcaatgggctgggtgacgcccaactccttaagctgtctgattccattcatatcatgggcatgaatcggctcttccagccattccagactgtatggctctgcctccctggcaaaaaaagcagcagtctttatatcaaaggcctgattggcatccaccgctatcccgatctcttctcccagagcctcccgcactttggctatccgttccagatcccgtttgatatttttgccattgtcactgcctaccttgaatttcactgttttataaccctcagacgcatagcggcacatatcgtctaccagctcctcatctgtcaaaagcagggaaccgcctcccttgtagcacaccgcatagtccttttgagcgcccagaaagcggtggaaaggcttctcatatctctgtgccaggatgtccagcatcattaagtcgacactgcccacatccactgcctgaccgctttgaaatccgctgtttcgaatctgccagtacaggctgtgcctccactcattgtaggatttattttctccggtcagcagtctgggcagcatagtccttacaaactctctgtctatggaaagatggtgggcgcagcagccctcctgatcatatagttccagaaagccggtctccggcgcaaaccttccaagcccaccggttccatccttaaatggcctgtacagaggaatctttctcatgctgtaataaaccgctttcgtgaattgaatcttgtccgtgaaatcaaacattacccgctcctcttttcgtgtgttttagctaaaaaacattattacatatcagtatttttgttacaattgacatattatacgagattcttgaaataaattgataaaaatatccatagtttcagttttttgtttcaatcggtctcacacagggttcagaacatttcattactgcaattttcccgcagcaaaagccggctctcccaaaaacggaaagccggcttttttcataaattacattaaattatactttttcatatacctccacaaggtggatttactgattcccagggattgggctgtggtcatccggttgccattatatttgagaaggctggcctgtatatttctcactctctcctcttccagcagacttcttttgggcttttcccagatttcctcttccttatccttttccgacagatcatagagactgctcagcaggcttaaaacgtactcgcttgtaattttccttttatttgccgttaaaatcatgcgctcacagaaagattccagctgaatatcattgttatcccagggaaaatccaaaatcttcgctctggcctccggtgtcagaatatgatatctggagtaccgttccagatacttctgataatacccatccagcaatatctccaaatcttccctgcggtcgcaggatttgggaagagtgatggtgaatgccttcagcagataataaagattcttgttgaacttaccctgattgaccagctttcttaaatctgcgcttgtacaggcaatgacccgggaatccaccacctgcacactctcgttctcaatatttaaaagactgaatctgtttttccgtatcacgcccagcaaatatttttgtacggaaaggctcatcttatcaatttccctaataaccagagtgccgtctcctgctttcataaaggaacccttctgttttttgtcaaatccctcctccgaaatgccaaacagagagtgcagctgctgggaagccggaatattttctatattcaccataacaaacggcccgttttttcttaagctgtaattatggattccctggcagaactgctcctgctcatctgaggaactgccttctactaggataggactgttggattgggcatagattttcgccagattcaccgcctcctttagccccggtcttctggacagaagatgatccaggtgctcataagctacaaaaccggtcaaaaacttttccttcattttatcctctgaccagttgagtctcatggttctgttgcaggatataattgcccccaaaataacatgatccaccacaataggctcagcaatgataacaatggcctggttgtcattgctgataaaggtagaataagtctcctcctgtccggtcaggagcttttgtatcatcaccggatccatggacggcagcagctccgtgatatgcatacctaccgccgcctttacagatgttttcagcatgttttccatcacccggttcatggtctgaaccaaaccgtccacgccaattttgatgatgccattaaaggagctgtccagaactgtggtaaactgggcataggtgtttttctcaaactccgccatatcgtagatagtttccgcctggttaatggcaatctcaatggattctcccgtagtggacaaatacacagcgggaaaattcttctgggccgcataccgtacgcatttttccccgcctatcagcacatccactccatctgagatggcgtgctccaccctctcataccagtcgtcctcatcgtttaagtggtaggtgacgattcttacctcatgcagctggtcaaaataagtggtgtcactgagcatgccagcccagcagaatatacctatcctgggaaatggcttgttcaccagctttttggccttaacgatcagaagtcccagctcctgcgccgtcatcactacctctaccgtaggcatgctggtgtattttttaacattactcgcctgatgcccccttgctacgactatgttcgccccctgctcaatagccatcctgacttcctctacaatattattgattgtagttgtccggatcataataacatgattctttcttttacttaaaattgcatctgcctgacggcacatggcctcattaggcaaaaaaaccgctatccccgacatacacccacctcatcataagaaatatacagaaatcaatagaatagtgccggataaataataacaaattaccgggaatatttcaatgtttctggcattattaaaaaatcaaaggtgaattctcctataaaaatcatatgccgtcatgggtatttttcatagggatcgggtcatccaattaatctgttttaacggaatttctttgggcagaaaaatgattcaatttacctgtttagtatcatactaacatcacgaaatagttaaaaagccctgaactccctttaaaataagggttccaaggctaaatatctattattcaagaggagtttgagactaaatgtctttcggccaccgcctatcctgttggctgacagggtaggcatttttactttcgcttattgttcctatctatataggtcagtaatgcgatcaggaatgacccgcctaaaaaaatatacttaagtactggtatgcatccatatgcacaacctcccctctactgcttcccgtatcattaattcatctatccaacatctcctcctgatccattcggttcctgcctgattatctattactactccgcagaacttcacctttaccctgcgtgatttttttggtatagaaaataattcatggtttttcacctttatcttctttcacaaattcttcacagattcatcaatctcccgtcacaatttacgggtatattaataattgtaaagaggtcagcacccctttaaaataaaactttttttcatacagccggcaggattcccccaatcttgccggctcctcccttttatcaggcaaatcacatatgctcctgattctttcagacttaattactttatattcctctgttcctctccagccacagtatcctttggtgatcgtctatctattttactctcagcctttcccagtttcctgaagcacttcctttatctgcggtatggttttgccgttctgacgcatttcctttatttcctcaatgcgagcgattgcttctacacgtttgaatctcctggtcagattcgtttctgcctgttcaaaaggcagcattccctcttctgtatagaactttagggtgctgtatctggcattggttagtcgcaccaattctccaattgatacatattctgactccattattttttcaattgttcgttgccttgacatatccagctccttacagattgtaacgacgtaatcttactccatggataggcattttaccgacaacagctccagggattaattcatatttaatattatctatttttacaaccggaactgcaccctcccgaagcacctcgtatacatgcccctgtgaagatattcgatccaatacattcttcaatctcagctgtgcgtttggaaaatattcttctgtatcgataaagattgattgttttctttcaaagaatgggaatatgaaattaaagccttttccagtctcagtagcagctgcctggcttttcagccgtaaaaaaccaaccgctacagtcccccataaagaacgtatttcaatgggataaagcgcttttgccaaggtgctttcattgcggaggcttgccatccgcgctgtgatttcattctgctcatagacagaaaagacctgataaaagcatagggactctaatagcagccataccaaaattatactttcctctgagatgggtccttcttctaaaaactcagcccttaacaaatctaactggcattcaaactcccttgtatcgcttacataggttttcagcttaatatttttatcgtaatataaatcacagcctaacaaactaggaaccttagaaagaagctgtttgctttgtaagcgttccgcgtaagttcgctctaattcctttttatttgcttttttcatggcatcttttattccttgttcattaaagtgccatttacccgtcgcaaggtcgtagttttcctccaaaaatacagcagcagctaatacctttaatacattctgctttgcagtttctctatgctcgctctcatagccgttaaagccaattagtgcaaaacgttctgataatgttaaatccatgataatcctcctttaactgtatttacttactacttactacttattatttatattatcactttgtgaatgaaattacaatatcttgagatgttaattctagacaattatttggattatcggattagatgcatttactcgtcagaatgtgagcgcctagtaaaaaggcggttcaaaaaaaataccccaacaattggggttgaaatgttcctggttccaaaaacacccaggagtaaacggtgtattgctattccagattttctttatgatgaacttcaggaatatatgggcccgactatatgagggcgagccggataaaagaattttctactttacaaaacacgctctggaaaaagaaatcaaacgcaaggcagaagctgccggcctgccagtcataagggctcatgatcttcgtcatagccatgccagccttcttatagaaatggcatttgacattctggaagtttctgaacgccttggacatgaatcggtacaaactacttggtacacctattctcacctttatcctgataaggatcaaaagcttgctggtcaactcaatagattgaggcggtcagaagatacttgaaattagtaatgtattgtgatatagtaaatataaagaaagcacccactccaaaggtggatgctccgagcaaaagggtaaatgtccttacggacaccgcctctcctgtggatcagacaggagaggcatttttatttgtgcttgttctcttatcgagaaaggtaagcaacgcaatgattaatccaccaaaagaaatcagcaatgccaatatccctaagaaaatcataatgacttcatatgcagtcatgtgcgccacctcccttcctatgtattccggcattccggttgtcattggctcgggaggttaccaccctgtcatgggtactttcataggcgattgtatcatacattcttatacgtttcaacagaatttcttcgagccaatgaacagtacatttaacattcttaacatcataataacatcacagggcatttaaaaagccctgaaatccctttaaaatagggggttcagggctaaatgtctgttattcgaattcaatcgtagccggcggcttcccagtacaatcataaagcacccggttcacgcccttcacttcattgacaatacgtctggtcactgtccctaagacctcccagggcagctctgcagattcagctgtcataaagtcagaggtaagcaccgccctcagcgcaatggcataatcataggttctctcatctcccatacatccaacagaacgcatattggtcaatgcggcaaaatactgtccaagtcccttatcaacgccagcctttgcgatttcttccctataaatggcatccgcctcctgaacgatcctaaccttctcaggagttacggcacctacgatcctgacaccaagtcccggaccagggaacggctgacggtaaaccagatactccggaataccaagctccaggcctgccttcctcacttcatctttaaataacagcctcaaaggctcaataatttccttaaaatccacatgctcaggaagccctcccacattgtgatgagacttgatcacagcagactttccaagaccggactcgattacatcaggataaatggttccctgtacaaagaaatccacggttccgattttcttagcctcatcctcgaatacacggataaattcctcaccaatgatcttacgctttgtttcaggatcttccacaccttccagcttgtcataaaaacggtcctgtgcattcacgcggataaagtttaaatcgtaatgtccttccggtccaaatactgcctcaacctcatccccctcatgcttacgaagaaggccatgatcaacaaacacacaggtaagctgctttcccaccgcctttgccagcataactgcagccacggaggaatctacgccgccggataaggcacaaagcaccttgccgtcgccaaccttttctctgatagactcaatggaagcttccacaaaagagtccatcttccagtcaccggagcacttgcagacattataaacaaaattggaaagcatcttggtgccctcctgggtatgcataacctcaggatggaactgtacggcataaaggccctgctcctcacattccataccagcaaccgggcatgacggtgtatgagccgtaacatggaacccttccggcgccttctctatataatctgtatggctcatccagcagacagttttggagcttacattttctaaaatcctgctgtcagcctccacgtcaacctctgtcttgccgtattcgctggcaggcgctgtggcaaccttgccgcccagcatatatgccattaactgggagccatagcagattcccaaaatcgggatccccatttcaaagatttccttctcacagtgaggggacgcctccttatatacgctgtttggaccacctgtaaaaatgattcctttcggattcatttccctaatcttgtccagtgacagtgtataagggtgaacctcacagtaaacattgcattctctgacccttctggcaatcagctggttgtactgtccgccgaaatccagaacgataatcatttctctcttcacgggtattcctcctaaaataatcttcagcaaataaagctttgggttacattatattctacttccaatggcttgacaagcattttcttgaaatcttcccagctctgtatccacggaaccttttcattattatacgaatgaatcaactggatatgcaggcatatccagttgattcacaatccctaggccgaaaatcagccaatgggcttatccaaatatctttttacgtaataaccggtgtatgaggatggacattctgctacttcttccggtgtgccctgggcgattattgtaccgcccttttctcctccctcaggtccgatatcaatgaggtaatccgcggtcttaatcacatccaggttatgttcaatgacgatcaccgtattgccgccttccgacagcttgcgcaaaatctcaatcagcttatggacatccgcaaagtgaaggccggtggtaggctcgtccaaaatgtaaatggtttttcctgttcccctcttgctcagctccgtcgccagcttgattctctgagcctctcctccggaaagctccgtagagggctgtccaagcctgatataggaaagccccacatcatttaaggtggcaatcttccttgcaatggaaggaacattttcaaagaatttgagagcttcctctactgtcatattcagaacatcataaatgctttttcccttgtacttaacatccagcgtctcacggttataccgttttccgccgcagacttcgcagggaacgtaaacatccggaaggaaatgcatctcgatcttaatgattccgtcgccgctgcaggcttcgcatcgtccgccctttacattaaagctgaaacgtcccttggaatatccctttgcctttgagtcaggagtggaagcaaataaatcacggatcaaatcaaatacccctgtataggttgccggattggatcttggggtccgtccaatgggagactggtcaatggcaatgatcttatccagctgctcagttccctcaattgtcttatgctttcctggaatgattctggcacggttcaacttttttgccagggatttatataggatttcgttgaccagagaactctttccggaaccggatacaccggtgacacaggtcatgactcccagagggaaggtcacgtcaatgttcttcaagttgttctctgccgctcctctcacggtcagataaccggcaggctgccgtctttcctttggaaccgggattttgatccgtccgcttaagtaagcccctgtaacggaatccttattcttcatgatctgcttcgcatttccggcagccactacatttccgccgtgctctcctgcaccgggaccgatatccacaatgtagtccgctgccatcatggtatcctcgtcatgttccaccacaattacgctgtttcccaaatcccgaagatgcaaaagggtttttaacaatttatcattatctctctgatgaagaccgatgctgggctcgtccagaatgtaagccacacccaccagaccggaaccgatctgagtcgccagacggattctctgggcttcgccgccggacagagtccctgtggcacgggtcagggtcagataatcaaggccaacgtcaatgaggaaagaaatcctggcccttatttcctttaagatctggtctccgatggcatgctgcataggcgtcagctccagctcgtccataaaattccggaacttgacaatggacatgttggtcgcttcataaatgttcttatctcctaccgtaacagccagagactcctttttcagcctcatcccgccgcaggcaggacagggggtaatccgcataaaggactcatactctgccttggaggactcagaataagtttcccggtatctccgggcaacgttctggaccaggccctcaaaggacacgtcataaataccttctcctcgctgccccttataatggaccttgatttcctttccattggttccatgaatgagaatatcatgaacttcctttggataatcctcaaagggagtgtccagacggaacttgtactctttggcaagagcttccaaaacagctctggtatagctgcccttatctgtacaggactgccagccaagcactacaatggccccctggtcaatacttaagctcttatccgggatcatcagatcctcgtcaaattccatcttatatccaagtccgaaacaatccgggcaggcgccgaaaggattgttgaatgaaaagctccttggctccacttcatcgatgctgattccgcagtccggacaggaaaagctctggctgaaattaatgggctgcccgtccataacatcaacagtcatcaggccgcttgccagctccatgacagtctcaatggagtcggtcagacgcttttcaatgcctttcctgatggcaagacggtccaccaccacctcgatgttatgcttgatattcttatccagcttgatttcctcggaaagctcataaagatttccatctatgcgcacccttacgtacccactcttgcgggcgtgctccagaacctttgcatgctctcccttccgtccccttacaacaggggccagcagctggatcctggtccgctccggcagctccatgatctgatccaccatctggtcaatggtctgcctgcggatctcccgcccgcacttgggacagtgagggatgccgatcctggcatataaaagtctcatataatcataaatctcagtgaccgttcccaccgtagaacgggggttgcggttggtagacttctggtcaatggaaatggccggtgacaacccttcaatgctttccacatccggcttctccatctgccctaaaaactgccgcgcataggaggaaagagactccatataacgcctctgcccctcggcatagatcgtatcaaaagccagggaagattttcctgaaccgctgagaccggttaggacaaccagctcatttcttgggatatccacggaaatgttctttaagttgtgctcattagcacctcttatcttaatatactgttttgccatactgtactcctgttatatactgaaatcctgaatctcacaacattcgaatgcggactctttaagcccgcacctctgttactcagcaaccgatttttcatattatagcatactttcaaccgctttgcaaacatttgttcgataattatttagaatcatgcagctgtttcctcaagggattgacagatctcagatcctgccggattctttcaaaaaactgtttcccctgaaaaaaagcatggtataatgattatataccaaaaaagaggaatgaggaaatatgaaaccacatccaatactgtcaattgtgctgctggcactctccctgtcagccgcagggtgcagcatgtcttcccggatacaggagacccctgcaggggaaacacttcccaaaacagacaagaacgaagaaacctcctccaatgccgcagaacctggagcagaagaaaaaaatcaggaaaacgtgaccataaccacctggtccctgcacaaatatgtaaaatactccgacaaaggggctctgatataccaatggaacagccgggaaccggaggttgtaatccctgatcagccggagtcccagtatctgatcaaccggagtttaagggagaatgaccagtcgttcagacgatatgactttatctatgattcagaggaatactttttgtcattggcagacagcaaagaagcatcggaaaggaaatctgtttttacctttgattatgaggtgctgcaaaacgacggcaaaattttaagcctccggcaaaattacgctgacacaaaggggaaaacaccctcagttacccgcacttacatcaattcctatgacgtggagacagggagaaaaatcactctttcagctatttcccataaccaggaaagcttaaagctggcccttgcccatgaattagccggacagataggggcagctgataccaatgcttcccttattacgcaactcatgtcgtcggacctgaataattttgcacttttaagagatggaatcctcatatgtcctgattcagtgatagaccaatccggttcttctcctgacaaagaatatctgatcccctatggccgtattaaaaaagagctgaatgattatgggaacaagctcatggatattgctgaaaaatccggggaggaaccagctgccgaaaagaaagagccggattatgtatttccggaaagcagtacggaatatttaacaggagctgacttacttgaaccggatgcttctgttctcagaatagcaagaaatgaaatttatgcccgccgcggaagaaaatttgacgccgtggacatacaggaatattttaaccggaaaccatggtaccatggtaatattgacccttctgcctttagcgaagaggcactgactgagacagaaaaaaggaacttaaacctgatccggactgcagaggatcagctgcaatcaaaagaaattaccgacagcggtgttaacctggaaccggaccgggattatctcctggatttagacggtgacggtacttgtgaaactgtccgctggactcccgtaaacgactctgcagattgggcttataccggcatggagcttactgttaacgggcaaaagcaagcctgtattcccaaagatatatggggcaatatcaggctgacggttttggatcttcaaaaggaggaccgggaggtggaacttcatctggaggtctcccaggattccgatacgatttcctccttcagcttctaccgataccaaaacggcagactggaaatgatcggcgatctggccgggaccgtctgcagcggaaggggatccttattccgccaaagcggcttaagagcggaaggcgacggcattcttgccgtaacagcagatactccctttatggggtcctctctccagtttggctgttactatgtggaccttctgttttcctataaggatggaagattagaagaaatccctcagagcatttacccgaaaaaggattatgaaccggttacatcagcgtttcttcatgaaaatccatataattactatgtggtgtcccatccctttgatgccttcaaaaccatgacagaaaacacgcctgcgttctctgctgttccgggagaaaccgtatgccccatagcctgggccgtacaggatggaagcttttatgtgcttgttatgaacgaggcaggaacctgcggctgggtaaaggaaaccccttgggacacggatccggataccgcctactatctcgcggtccctgcctggggataaccatgtaatacagattaaaacccataacaaagatatcccctgcggtaaacgctgcaggggataatcatttatttatcttccggattttcatacctggcagtcaggcatgtccggctttaaatcaaatcagcagcgacccacataaaacgccccggcggcgttgtccaaacctctctgtaggtggcaatattggcaggaggccagtaaggaagatcttcatttcctctggtctggacacctacgggcatttcgcccacggtttctcccagcaaagcagtatactcctgtccataatggttgccttccccgtaaatcagggactggccaaaggggttcttcccaagggtccagtaaagctgctctcttgcgatttcaattaattcccagtccccgaaatacgtgcctatgatggatgcagcctttcccatggacagctggatggcagaatttcctcggtaggaaaaccacaccgggaacgttcttatatagtatccgtcccctaagtcaacgccctgtttaagctgcgcgatgtaattgacccgttctctttcataatccaccttcgggtgtaccacatggaaggcttcctgatcctctgcttcgctgatgtgatgaattccggccggcagcatgccgtagggagccgtatatttctgaaggcctttcaaatattctccatggagtttgaggctctcttcccacacatttctgttctcatgatccgtaagggcacgacacacctctgccagggccatggcaaacacctgatctcttgcctgatgggaaaaatggacgatatgagtcctgtcttcatccctgtagaaaaatcccttcatgggcaggttatctctgttctcctggcaggaaacaaccttttttgcgtactgggcagcctggtcataaaaataacggtctccggtgattttgtaaatcctggcagccgcccatgccgcaacggcataatactgagaacggctggaacctgccgtatgctccagcaaatgatatggtccttccactcccacttcctggaaccgttcatgggcaaactgaaagtcttctttcgcagcatccacacatttccatgccacttccctgtccagctcctgaaaggcttcccctgcgccggcttccaccgcagaaaaaacaaagttttcaaaggaccggttatgaacatctgcatcacagtcatccatgttgccgatgaagttgtcggtccacctgcggatggccgcatgagatgcccggtatccgtctccaaggcgcatacggagtacaaaatccagtccccagttggcttcttccatcattctgcggtaaagcatgggatcagaatcctttacttttcctgcggaagcaatcatggcatctaagatctctgccgtctgcatggtctgctgggaaacatccgccgcatcgtgccagcctcccgcatacaccatcttcaccccattgtgctctgcaaccacatcctggtggcaggttccatgacagttaggaaccggatatccgcaccgctcacaataaagaaagttagtcagcttccataaagcgcttttcaatacgtcattacctatgataaagcgctcgctcaccgtatttccaaaccggatcctgtacgcgccttcagtttttaaatctgaaaaatccagtaccccgaaagctcctaagtggttttccaccagctcaatcggtccccggtatgccacttcaacccctgagtcaaggctggaaaaaccttcctcaaagccgccttctttcacaatttcaaactctttggctgaagtattggcgatggcagtctttcttccgtccgtaaaatagccggtcgtggaaaacacaacttcctcttcctcacactgccagccatggaccactcccggctttacctcctgaagctggatatcgcagagttcaaaccgcaaatcatctccagtgctcacttccttgccgtaacggtgaatgttaaaggatatttcctcaattgcgtcatgggcaatggaatcaatctcccaggtagcagtattccattcattattttttaagttaatggcatggaagccttctctcgaataaacatcgggtatcttgatttccccgttattgacaaagcccacacgaacgatgggactgtgaaggccgggacaaatggggcggatcttaaaccatatcctgttcccttttcccagttccagcccctttacattcagccttgcaatatagcttccaaaggtggcatacaagcctgctgccgcatcgtttgcccggacctcattatccggccaatggtctgcgcgggcctttgtctccaggcttaaaacgttcccatccttaacctgaaattccccctcgccgtcaaaggtccatggctccaggctggctccatcccatagacttacggaagataaaaccggcttttttaaattgtaagtctccatgctcttgtcatattccggttttaaggggtaatgtacatataatgattctattaatttattttttaattgctgatccatttttgcctcctgatgaactagaggatatgcctgcatatccggtgatgcccaataaagctgggcgcactgttcacaaatttaagcgggcaacgagccagatgaacatgcaagcaggttcactcggctttcagcccaatttctcatccaaaaattattctttgatttcaaatatagcttccgtctcaacgggaatattgccaggcaatacattaacgccaatggcggaacgggccggtacattctccggtccaaaaagctctgccaataattcgcttcccccgttagccactgccggctgatcgtaaaaggtatccgcactcgccacaaaggtaagaattttaactggacactttacccggttcaaatctccgatcttatcctgcagcactgaaagaacatttaacatggcatctctggaaaagacttttccttcttctgttgtaaattcactgcccagctttccggaaacccgttccgttccgatcaccggcccgcaccctgatatgtacaccaggctctttccaaattcctggcaaggggaatacactccgccttttggcggagccgccgggagttccaaattaagttccttcagtttttcataaatattcatgtctgcttccttctttccttgtttttgcccatcttcccagggcatacaggtatccctgaaaggggctccttttatttaattaaagccttttcttaacagccgccctgcggtgcggtccgcgacgctgccgtctgccagcacctgttttcctcccatgagcaccagatccatgcccgtgcacaggtcatgttttccggtgtaatccgcatgatccaggaatttctccggttgagataccaatatatccgcatgatatcccggccttataagtcctctgtcctccaaacccatccgttttgccggcagataggtcatctttttgatggcctgttccatggacagcactctgcgctttatgacaaaatcatttataaatctggccgttgtcccaagtagacggggatgggcattctttccgtcaccgccgtacagggagtcggaaatcagaaaggtaaaggggagtctggccactgcgtccacatcctcctgggacatgcttaaaacaatgatccccaccttcccgttttcctccacaagcaaatcagctaccagatcagaaggaacttcatatcccattttctccgccagcacaccgatggtctgcccctgcataaaggcgttcttatccctggtcacagaactgataaggattctgtcccagccaatgctttccgacatattgtcccaccctgggtgaatcttttcaagctctgacttaagcctctgctttccctccggccctgataagcgtttcaccagcgcctctaaggattcttccatgatggttggtgggagcagggactgaagagtggtggagccgccgtcataaggataaaaatccgcggtgacatcctgccctgcgttccttgcctcttcgatctttccaatagcctcaaatatcttgcggttccagtttttgattcccgtagattttaaatggctgatatttaagggaacccctgcctttgccgccacatcgatcacttcctccaccgattccactaagctgtctccttctccgcggatatgggtgcagagaatgccgccgctgaccgccgccgcctttaccaccgccgtaagctcgtcccggttggaatagcattccggctgatacatgatacccagcgtaactccaaaggcaccctgggccattgcgcttttcacatactcctgtgcttttaccagttcttcctctgtatacgccttgcttccaaagccctttagggccaccttgatgctgtccgaggccgcaaaaaagcccatattgatgggaagatccgctgcttccagtgcattcccgtaatcctcataagtttcaaagaccagatctccaggcgctgtccctatcaccggctccaggtaatcatacaattccttccgggaacccctggtggacggcacaggcgcaagaccgcagtttcccacaaaggtggtggtgatcccctgggtcagctctatttccccgaaatggggattcataaaaggcgcaatatcgcagtgccggtgaatatcaatgaaaccgggagttaccgccttccctgcggcatcgatgatccgggcgccttccttttttatatccggggcaatttctacaattgtttccccttctataagaatatctccctgaaacggcgaacttccgcttccgtcataaatcaacccttttttgatcaggatatcactcatatcagcattcctcttgcatccactttttgttttctgagagaaccgttttccagaagataaatggagttctgcatgttgacagccgtacatacatgaatggggatcagggaaatcacctgccctacctgcagcccggtttggccgtttatggccgtgatgatcccatgctcttcattcatccgtgacagccttaagttgtcgtccccttccaccaccgcatatccaggatagtaaaagggcggctggcccggagccacatccgtaggaaagcacttggttcctccgtccaccacagcgtattctgagtgctggcagctgactacggtggcatagaaacggacggcaatctggctgagttcggccactttttcctttgtcagcataaaatcatcgaaaatataggtgcccggacggatctcgtttaccatgcccgtctgagccactaatgtaccggtgggggaagaaccggcgctgatatcctgtatctcaactcccgcatttttcagcatcaaggcggtttcagccatcatcttcccctcttcttcagcagccagaaggttatcctccgtgggtttgccggaaagaatgaggctcttaaatgtaaaaatacctgtcaggtttagatgcttcatctccttaacagcaagggccagttccaccgcccggtccatgggtacccccgtgcggcctgctcccgtatcgatctccatacggacttccagaaccatatcctggccggaggcctcctgttccagggcctttgcgccttccaggctgtcaatggttaaaatgagccttttgatcttctttgccagagtgatcgcccgctggatccggaaatgtcccaccatggggtatgcaatgaagatgtcctccatgcctccgtcagccatgacctctgcctcgctcacctttgcgcaggtgatcccgcttgctccggccttttcctgcatttgggcaaataagggcattttatgtgtcttgatatgagggcgcagacggcagccggccttgtcagccgcttcctgcatccgtcttatattcttttctgccagatctacatcaatgaccagacagggagtctccagttgttcaatctgttcctgtgtaagttccatgcttcctcccttctcagcttttatagctgtcagccacgctccgcaccaccagattttctttgattaattccggggtcatatggcactcaaagtctttcttatttacatgaaccgttattccttccggcgatgtgatatcaaaaaagttatcagagaaaatcacatcaaaatccttaaagtaaagctccacatactggcaaaagcaggcggccttcaccgtgatatgaaagctatggtctgactctgaaaccgaaacatcataagccggagccttatagtcaaaatgctttggctttacaaacagcaccgtccgttctgccaccagttcttctcctctgtataatcggaacacggaaaaaacagaagaacgggcagcctcatcatcagtccaggaagaaaaatctgcttccatgcactttttcacggacagagcgggcagaccgccttcccaggccttttcccataatacccggaactcatgatcctttaactggatttccgtcctgcaccgttcttcctccctggtatcattgtgaacgtaataggaaatatggggagaaagctctttttcttcaccaatggaaattgtaaagggcgcataaaacctgcgtgctccgtaatggagcgctttccagcgtccataatagtcaatgctggcccaggaagccaccggccagcagtcatttaactgccagtaaagggaacccatgcattgtccccgttttcttctccagtgctccacgccatattcaatggcctttaactgcagaatctgggaaatatatgccaaagagtccgtatcctttggatagaggaaataatccgctatatagtttaatattttcccgttagcagccggatttttctggtgagattccatgaccttgctgaaaatgttccggtccttaagcaaggtaaaggaagctatggttttgctgtggggaaaggactgaaatccgtattccgagcaaaagctgaaatccccgtattccgtaaatggctttcctgaatgccacacctcccaataatgctgatccccccggttaattccattgggattgtcaaaagcacctcctgatgacggagaagacggccagtaaaaggtgatgtcgtcacaagcccttattgcacggggaaggatatattcaaatatcttcgtatagtctgccttatacctggggtgatggccctttaacctggcccactcatctgcccagccccattccatttcattgtttccgcaccataaggccagacatgcatgatgccttaatcggcggacattgtcctttgtttcttccacaatgtcctcttcaaaattgtcatttaatgcataaacattgcagccgaacattaagtcctgccagactaaaattccttcttcatcgcatttgtcatagaaatagtcatcaggataataacctccgccccagacccttaagcaattgaaatttgcggcagcacaatcctcgatcagccgttctgtccgttcctttgtcacccttgttaaaatattatcttccgggatataatttgcgcccatggtaaatatcctgatcccattgaccgtaatggcaaattcattaccgtattcattcttatccgtgctcacggtcaccgtccgaaggcccatccggcactcataggtgtcaagagaagttcccgcctcatcaagcaggcggatgctcactttgtataagggctgctctcccaggccgttgggccaccacagctccggctccttgataatttcttcaaactgcaattctccgctgctacgaaccgttttgcagacaggcttgccttccgggtctgtgatctcaacctcagcaaaccatgactgcccgcctacccggctctctccacaggagaatggctgctttacctttatttcaattttcagccttacattatccctgtcctcatgttcctgcctgatatggacatcttcgatttttgcagtatttatatattcgatggctatgtcccggaaaatccccatatcgggaagttgcggaccccagtcccagccgaacatataatgggctttgcgaagggccgcattcccacggatacagccggtggaggcatataaaatatcgttttcctcatcttctttccttacaaaattcaaaggggaccggaataaaatttcaatccggtttttcccttcctgtaagtattcctttattggaaaacggtaggttctgtgcatatctcttgtctccgccaccaggcagccgttgatgcatatggaagcaatggtatccagccctgcgcagacaagctccgcaccggaacactccaaatcctctcgtgataccggaaagcttcttccatagaggtaatccattcccatcagctcccggacctcatattcattgcatctccaataagggtcctcgatcagcttattgcgaagcatatcgctgatcagcgttccaggcacttctcccgtatatatggcatcatgagcggccccttcctgctgccattcccagactccatttaatgattgtgtttttcccatagttcgtctcctaatgaatccagctccttacgcctttaagccgctggtcgcaattccttccacaaagtttctctggaaaattccaaagcagacaatgaccggaagaacaaatacaactgccgccgccatcagccttgcccagtccacggaatattcgctcatgtactgctgaagtcccagggaaagtgtatacatgccgggctttgtgatgaaaatcaaaggatacaggtaatcgctccaggcatccagaaacgcatatattccgatggtggtcaaaaccggcttgcaaaggggcagcgcgattttataataacgctggaattccgtggctccatcgattttccctgcctcgattaagctgttgggaatgcctgtaaaaaactgccgcacaataacaatataataagcctttccaaaaaatgcaggcaggatcaggggaacataagtattggtaagtcccagtttggaatagatcttatacaatggcaccatggtaaccgttatggggatcatcatggttgccataaccagccctgagataatgtccgcacctttccatttgatttttgccagagaataggcaaccatgggtgtgaccaaaagctgccctataagggaaatagccgtaataaacaccgtatttcccatgtacttaaaatatgggatggctgcaaaagctgccggatagttttccttcacccactggcgcggaaacagctgtacaggaatggtgaacgcgtcgttattggttttaaaagaagtcagcaccattaccataaagggggatatgaaaatcaaagccagagcaaccaccagagcaaaaaataaaactttgcctattatttttttcattcttattcacctccggcattttctgttgcttttcttgttacctttgtcataacaactgtcaggattgcaacaatgataaacagcacccaagccattgcagaagcttttcccatttttaaataggtaaatgcattgtggaacacgtacagcggatacataagaatggagttctcaggaccgccggcggcgcttccgccttttactccggcattggcagtgacaataatgtacacctgctggaaatactggaatgcattgatggtgcttaaaatggcctggtacaccagcacatgggcaatgcagggtacggtaatatgcaaaaatctcgatacccttccggctccgtcgatttcagccgactcatagtagcttctgggcacggactgtaaggctgacatacataccagcatcatggtacccgtattccaggttcccatgagcaccagcgcccacttggtataatgggcatccataagccaggccggtccgctgatcccaaaccagcttaacacgttattgatataaccgtaggtaggatcaaacatccagatccacaccatggtcgccgcaaccatggggatcacggaaggcaggaaaaatgccgttctcacaaatccccggcccttaaaattggaacatacgatgctggccagaagcagcgccacaaacaggttgatgggcgtagatacaaaagccataaataaagtatttcccaaactcttccaaacaaggggatcactgaagatgtctttgaaattatcaagccccacccactggggagttgtaacggcattgaactttgtcaggctgtaatataaagagcttatgagcggatatacgctaaaagccagaaagcccagaatccacggagatgaaaacagcagcccgtttataaaatcccgctgtgttgcgtttcgtcccttcattccttttcccctttcaaacatgaagatcagggcactgcaatatgcagatttctgcttacagcgcccttaatatgtgaattgttattttaagtttgcactctgatcagtcagtgctttcagtgcctcttcaggagttttggcacctgagtagacggtatccaatgcggcattaatcatagatatgtattcatcataatctgccattgccggatactgaatacccttttccagtttcagcgcatcaataaattctgcaaatccgggaactgccttgatatcagcatcatcgtataaagcttttacagccggaagatttcctgttccaaggtcaatgatcttggcgccttcctgactgcagagccattttgtgaaatcccaggctccttctttgtttttagccattgcaggcactgccacggaatcagtttcgtaacggctggttcctcttaaatctgggtttgcctctgttccggggatcagggtaattccgtaatcaacggttgaattaaagtttttcatcatggtcggcagccaggaaccgtcgagacggaacagctgcttgccctggaaaaacatatcctgctctgtataacggtttgtatttgccgttccgataaagccatccagtgcttttccgccaaactggtttctgtattttacgttcatattaaggctgtctaaaatgcctgcattattcggggtaacattagaatcctcatcccaccatcttccgccaaagccataaatcagttcctgtctggcagatgcatatgggaataagggatatccaagcacctcaatatttccgctgccgtctacctttgtagccttaaccgccatctcatacatctcttccatggttttgggcggctcggtgtaaccggcttccttcagcagttccttgttgtaatacatctggatggtgtaagcatcaagaggaagggcataaagttctctgtcaatggtatttgcattcacagactgctctgaataaatggaagtatcgaaggattccttgtctgcatatggctgcaggctttccagcaagccattcttctgatactgaaccacggtctggttgcttattttgatgacatcaggtgattcgttgctgctcatggctacaataaccttctgggcatccgtgacgcttaagccttccactttataattgctctgggaagcgttgtactcactgatggctttctcatagacagccgcctcatcccctgtgttgttgtaccagaaggtgatcacctgggcttccttgttttctgccggggctgatgtttccccaaccgtcgtctctgcgccggctgctgtagtctgcggagaagtggtctgtgttgttgaaccgccgccgcagcctgtaaccgccaatgcagccatacctgcagccatgataatacgtattgctcttttcataaattacctccttataaaagtacgctttgaactttttgttgattatctttcaacattttgtttaactcataatcaatatatactatatttcttatcttttgtcaacaataataatccagtatatttttattttttgtttgttttttataatctttctttttcacttcaacaaataatgtattattactggactttatctcacatttcatttataattcatttagacattttgttgaaaggataaaattactatgggatatgtttctgataacttaaacctgttgtctgatatcgccaaatgcattgcaatgcaatttggagaaaactgtgaagtggttctccatgatctcaccctgccctatgaccagaccatcgtcgccatctggaatgggcatgtgaccggaagaaaggtgggagacggcggcaccaatgcgggattggagatcttaaaaggctctgcatcaccggatgatcagtacagctatatcaacgccacccccaccggccgtattttacgttcttccagcaagtactttcgagacgaatatggaaaagtcaacggaagtctgtgcatcaacttagatattactgatatggttaaatttgaaaacaccttacggtccttaacctgctccggctccaccaccatccctcagactccggaactgtttgtgggcaatgttgatgagcttctggaaatcatgatgaaagaagccgtaagcatgaccggaaaatctgttgggaatttaacaaaggaagagaaggtggctgttgtccataacttggatgacaagggatttttcctgattaaaaaggctgctgaaaaactggccgactttctggggctgtccagatacagcatttataactacttgaatgaaagtactcattgatttagtgcaattttgcagatgaaaaagaggttcttccaaaagccttgatatggctttaagaagaacctcttttatgtaaagatgaaggcagcctgagaatgccggtgagatatcttttcatccttaactcttattctgtgaacaggaagctctcctgttcaattcctattcctgtatgataaatcacctgagccagctttttcagatcctgttcctgtattttcccttcatcaagcattgctttcagcttttcctgctttgatggttccagccggtaaccatatcttgaatatttttcccatgtttccacattcatgttcagaggctttagcctggggaatatctggtttctgataaactcaaaaatccgtattccaccgtaatccagatctccagtgtgataaaacctcacttcatcttccggaagaaccgagaccagctctgcaagaaccctcctctcgccaggagaaaaatatccatgagaaaataaaacaagggtctctttctcataaggaagcgtcatgtaattggccttattttctacggttatgactttccttatgttctgttttgccactatggaaacccttttaagagtttcgctgtttaaaactgttccatagggaaaaagagataaatcaatcacatgatcattgattttgaccagcaaatccccttttagggataattcatccccataatgatccaggtaaatctgagccaggatctctgactcagtcatattatcatcaatgatatcataatacttcccggcagctgatgccacatacttctgcatcttttcttcgaaaaccttggaacctcctaaatactgcttgctgaacacccttttatacacagatccttccagtctgtcaatcccaagaaagcatttaaaattcaattccctgttttcagagttaaattccttcggttcttttccttttcctgcctccagacttttaagaacatcatcgtaataagcctgaatccatggcttatgaatctttttcacctgctcttctacggctttcttaatctctttgatacggtctgactttggaattttgcctgatatcttataaagttctcttacactgcaaagagaataatttaccgtataaatatccgaccttccatttatggacttaggctcacattgtataagccccatactttctaattcctcagcctgctttaacaaattctgtttcccaacagcatccagatgctcctgctgaatgttaatatttctattcccttttgcgttctcccgccagttcacagtactgtcttcaatttcatcaataattacatcaatcagtgtctgcattaatctcctcatcatcatcaagctccctcatcagttccggaaagctttccctctcaaattcctgaatggatatggattttttatttggattggcgaacacaaaggttttgtccacattctccacataattctggatcttgtcattggttgcactgataatggcctggaagcccagtccccggatcagctcaatgcagcttgccaccttctccgcatccatcttggaaaacgcctcatcaagcaccaccaggcggagggtcggattcctctgaatcttgggagataagctgatccggtaagcctgggcaaagctggccagcaaggccacgtaaagggggttctgcccctcacctccggaattcttcttaatcattttacttaaccggatcttaataacttcgtcctcgttctggatgatctgctgcatatcaaaggataaataggtccggtaatccgcatacttatccatgttccgcttggcctcatccatctgctctgccgtggcgttttccggcggaatgaaaatgtttatcaagtcattgatcatttccccgtactggctctcatgttccatggtgaacaagttcatctggttatccagggaatccgtaagatgggcaggatttacttccagggaatcatccatgaacatgtcataatatcttccgtccgctcccttattccttccgatgacaaactggtacttatccttgccgaaatccagcttgctgatgatccgattcagctcatcctttcgcaaaagcgcatcccgtatggcgctccggatcttgaacatgaagtcatccttaaaatgaagaacagcggactttgcctgctcagcagccatctttttatattcttccagactgccgcactccatgatctcaagaaggcggtcatattcctcattatcctttgctgtgagagaaaagttccggttgggatattttcttgcgtaatcgcccctggcacctacaagggtctggaatgcctggtcgcgggcatcttcagcctccctgcattttccccagaatttattcttcaattgatcgtatcggtgagtttccctgctttctaaaaattcccttactttatcttccagttcttcatccggttccaattcccgttcttttaagaccagctcctcctgcagctgcagggattccctgcgaaaccgttctatttcactgttgatgccaaagatcagtttatcaaccgttctctgttcttcccgtttcctatcgcaaagctgcaagacggcttctctttccttcacccattcctctacatcctgggccttcagcttttccagcttctgttccagccgcctgatctctttttccttttccttaaaggccgccatatcctgccgccactctaagtaaacactaacatcctcgcttaagccctccatggataaaatccggcggcattcctttaggacctgttcctgaggctttttctcctcttccatggaaaccaggttcttttccagaagacggatccttctcctgacgctgtccttgccgatgtaggcaaatttcgtgtaattatcaggattcatatgctgcagccggaaggtatggtacagcatacagtcaggggtcaccccgatccggcagcggcgcagttctgtgaggctccggcacttgacgacctttcccaaaagcaagtcaatatacggctgtaaataagcctccctcacaatgatctcttctgaaaggcctcctttttccacttcataggaattccggctcacccgttccgtgtccaggacggccacattgaaatattccgccttgtccagctctccgtaaacagccatggccgtttccgaataagccggggcaactaccagggacagcttgttatttcccagatagccttccaccgcatttctccaggactcatccctgatatccagaagatccgcaagcacatggacctccaccgccttgccggtttcctctaaaagccgctgctggatcagagatctggcacgttccagatactttggatacgccttgtttccggcctttagctgggccagctcttcacttgtctggcgctcctttttccggatgtcccgaaggatcccttccgcctctttctgggtttcttccgtttccttacgcatttcggcaatggaccgttttaagcggtccagcttttcctcatcaatggtattcttttcaaattcttctatgtcccatatggtctggttggaggtggcctcttcgtcgatccattcctttagccgctctcctgtctgtgcccacttagcagagcttttgcttaaatggcttaacagctcccttgcagactccagctggtttttcaaatcctcataaccggtggaagaaatccggcggagcagctcatttccctgaagggttaaatcttccatctgcctttccagggccgccttttgttcttcctggcggctgaggtcttcccttgcaagaccggacttgtccgtcaatgcctgaatccttgcctgataatccagaatctccatcttgcggaagaaatacgtattttcacctatctcctcttctttttcccggacggctgagaacttttccttcatttcctttaaataagcgatctccacgccagtatcttcgatcttctttcgcatccgcccgtactgcatgacgctttcctgcatgtcctcaatgtggatgtcctgttccatgcagatgtattccttcacaaagtcttccagcttgatgttcatgcggaagggaatggcccgtttaaacaaaagaggaaatttttccgaatccaggccgcctaagtacacgtcgtacagctgcctgcggaaccgctcattatgggaggttgcaaaataatcctctttggcataaagagtctgtaaataagccgacacctcctgggtagtcatggtcctggaaccggtccggtagccgttttcccaaagagggcctttatgccagaaaaactttctggatatttcattggtggccgtttccacgtcaaagacgattccaatgcactggcattcttccgtatccgtccgtttcagctccagcacaatggtggaggaaaaattctggttccttaaataggcgaattcgttgttttcaccgatgttcaccatgccccgcagatattcgatcagactcctgtcagaatcatcggccgcagccttgttaaagaatcccctgccatcagtattggcataaaggagaatctgcatggcatcaatgaccgtggactttccgcttccggaatgaccggtgaaaaaattgatctcccggttaaaggataaggtcttcctggtgatataatgccagttgttaaggagtatcctggacagggcttcaaatttctggttcgtcatcgtcatcttctccttccccaaatgattccagcagggcccgcacatcatctcccaggagcaccacattgatgcagggatagatgatcatacggctgtccccatctaaatcctccagaatatccaaaggctctaaaatttgatatttctttaacaaagtaattgcccggcgaatttctgtgggggaaggctgtttcttaaataagcggtaatttcccagcttttcatggatctcacttaacgtggtgtaaatgttcacactaatggaaactgccgccatctgctcatcatagatcagttttaagatcagtaaataaagggttgccagcttgggaagcttgtcccccaccgtgttctctccctggatataaataaggcccagctggctgttttctaaaacttccaccccgctgacggcaaagtaggccctgataaattccagatgcttgttgcagattttaaattccgggttataggcaaaccggctggtacgcttgtcatacttatgctccagcacaaaggtctgctgcaagagaagccttaagcctaaccttacctcttccttttctccctgccccaatgcgtcataatatgggatctggctgatgatgccagcattttcttcataggtcatgattcgtcctccttacaaataccagccttggatagcggtatctgccgttgtcaatgagctctgcctcctgattctccacctgatacagacttttccttctggtagagtaatcataggccaggatcagcttttcaaattcctcaggggaactgaccgtatcttcctttacctccatacggccgttttccagatgagcctctatataggtttcaatctctttccggctgtagcggctttttaagcggtttaaatccaggatctcttccatggtaagctccgcaggctcttcctcaggcattaagttctccttaaagcctgaccttgcccttctctttttgtagagagatttttcagaaaggagggataactgggataaattcatgcggtatcccacttcctttacggcttcatcctggtcctctgtttcggaaagatgatttaaaagcctgattacaagccccttcatattgtcttcctggtttaacagatagttaagccttgtaaccgttgcccggatataccgggaatgctccttatccatgttggcaatgcggtgttcaatgtcgtcaaatcctctttcgatctgatccagcttttctgcaatatccgctgccgtcaccttttgcccgctgcggcggctcatctgttccatccattccacatcttcccgcatggaactgatccaacgcttgatatcatttttgtacagatagaaattatccgaagttttcagcatgtggtatttcttttttactatttcctccacatatccttctaagtgttcttttaacaattccccatatgccctttgctccaaaagacttgcaaagaatttatccatgttgtgaagcatgtcctgtaaagtcttgttaaggcgctttgtattgacataagctgtgtttaaaaggcttacgccggccctgggatcatttttcagtgaaaagaggatagcgtagacgttctggatataaatctgggtctcatcctcttcgtcatttgccagctttaaaaaagcctcgatcatgacggctgcataatcaggaatcacgatattcaccgccatggaggcataatcatccactttccgaagccagccggcccttagcagccagtttaagaccctgaccgcggtaggctctaaggcatccgcctcatcttccagctcatcctgccagatgaccagacgctttgcggtaaaatattcctccaggacctgaatgcacacctcacggcttaaaaagtaattgctgtattcatattcctcattgatttttaacaatgcttctatgtaagtggaccggttgatggaacggaacaatccccagaaccggtcgggtatttcattcatcagtatcatttgtttcgcttcatctcctgtttttctgcttttctgattccagtcatgaaataacggctttattctgtaaaagcggacaaaaagaaacggctatcatcagttacgacagccgattgatcttcgttttcacgggttcttcttttaatccaaggcctctttcatcctattataacaaaaatccccatttcttacaataaaattatacttaaacgtccggcagactgctgtcctcagggtggttacctgtcacatgtatcgggtttcatctttcaaaagattgcctcgctgatacagtgcctcagctttctttagtcctgtagcatcaacgattttccatatctttcattgcccgcccaaactccatatggtatcatagagattaaatacaaatgatatttggtaaggagaatccccgaatatgaaatttaacaatccaaccttttttaaatggttcaaatcaatcctgctggttgttgcagtgattttattgttgtgttctattctgtgcggctacatgctcgttctgctccgtaacaatgccatccaaatgagcagcaatttaacccaatatattcagacaaatattgattcccgcctgtttgagctgtataaatactcctccactttggaactccatcctgccaacatctatcttaagaaattaaaaacagctccgaaaaccatggatccgaaagtctatcagttcagtgatcagatgttaaactacaattattccaataaattaattaacagtatattcatctattacccaaacctccagaaaattgtgggcaatttaggctgttatgatgcagactcctattatgccctggataatctcctgttgttaaacggctatgaacaatggctggaaaccctcaccatggaatcagacagcgactttgcctatctgcagtcagacagccgaagccagttctgttatatccggaagataagaaactcagaggagcttgcaggctatctggtttttgagctgaatacggatgaactgttaaattccaccctcatgacagaaaactccggggatcctcattcatctcttggtattttactgaatggccagctgattgcctacacaggaaacagcgaggaactgacccggcttgccacattgctgcccaataccttaaaggctcccgttattttggaggaatcctctgccctgctgtatgccagaccctcctctttgcagaatctgtgctatttaaacgtatatttccataagaaaaacttacagccggtatatattactctgggaatctgcatcctgggcatcatcgcctgcggaatatcaggtatcctcgcttctgtacacatcagccgtaagaatatcagacccctcatcaatctgctggataaaatcggagtcatcccggataaagaaaatgatgaatatgagaccattcataaacgcttcgaccagttaatcaaagaccactgggaaaacaccgaaaaagtacaggaacagcagtccctgattaacaatttcttcttaaaaacagtactttacggcgatatgcacagcgaatatgctatcttcagtgtggccaaaagatgcaatattttatttgaaaatccacgctatttaattgccatagctgaacccatttccgacatgccccagccggatgaagaacagctttttacgatcaaccaatattgcgaaacacaccattttgatgtgatatcctcctttcatgaaggaaatatcgtgattctttttaatattgaggaaacggttacacagaatatgatttcaaagtttataaaagagatgaaggcagatgtgttcggagaagataaatgggtcattgcccttggtttagactatgacggactcgtcaatatacaatacagctatgctcaggctgttacggccctgcattaccaaatcaaacaggaatcctctgtcatctgctataacaactacatggaaacgattacatcaccaggtttatcctatattgaaacctttgagaacttctccaaaaatatgatccaaaacgattatagcgccgcactggtactggtgcccgctgtttttgacaattatttttcccaggaggattcctctgaaattactaaagtgaaattcagagccatacagaatcttttgctaaatgccaggcagaaggccaaacgggagattcagacatccggctgcagcattcatacggcgcagattctgtcctgcacttcccctgcacagctgcgcgagtatacgcagtgtattttaaaagaattgtcaaccccctcacaaagtacaaaaaacagcacgtccagcatagccgaacgtgccaaaaacatcattcacagggatttttccgatcccatgctgggtctttaccggatttcagcagaactgagcaccagtgactcttacctttccactacctttaaaaccgcctttggaatcggtgtggtacagtatatcaattccctgcggattgaacaggccaaaaaactgatctgcaatacaaatttaagtatcagggaaattgcattagccgtaggattttccagtgatgcctcctttatccgggttttcaagcgctacgagctgcagacacccaacactctgagaaagaatcagagataaggactggttctgttatgatatcctcttaatgatttcccggtttatcttcctgcgcagtttaaacagataattactgctggaagggtatgacttaaatgtcattttttccttctccccttccagaatcaaagactccactgtttcccggtttgataagctttccagcagttccatggcccgcaggtcatacaaagcttccatctgcacctgattcctgatggaggaaaccacactgccttcctctcccggatacaccagataaggatctcctgaaggaaatgcatagcccgcatgggtttccacataaggatcaatatgccgtagggaaaaagcagaattataaaaattgtaaccccagtgcaggaagcctttgatgcggtacagatacatgagcactcccatgatccggtttcttgcacttggcatcccatagaaccggtttggcacatccacacattgtacgcagcaataatacacccaaagatcctccacaccatggtcaataaatggctggatatggtcatcagccggaatcgggtgctctacgataccctgcttgtaaaattcgtagctgctgagcgcatccacaatggtatacccctctaacagatcagtaacctgttttttggctgtcagatagctttccagatgttcctccccaggctcatccgaaatatggaaaaacagctggttcttctcatatcccagatctgccagcttccccagaagcgccggcacaaagctttccagaaaacgccggtactccggggaaacagcttctacctcccaaccaaagatctgctccatgccgttctctgtttcagcaatgatctttggtgtggcatatgctccccactgggtaaagaagtggacgatttccagattctgaatcccatatttcctgcatagcttacaccaccgctccagctgactgaatccgaatcggtactgcccttctttccgtatcacctccaccagctggacggttgtcctgtcccctccaactgccgtatcaagcggctgtgtaaaaacaggcgtcagcagcaagttgaccccgcactcttctcctgcaaaacggatgtagttctcaacgatctgccaatgcgcctcactaaaagccttaaccttgtaatagtccgccagacaatccgcgtggaaccactccgtatgcagaagcttctgctccggcaggacagccggaagtacctgcagctgcaaggtctgcttccagttctgttccactgcatggggattatggataatcacgccgtttgcacaggttgtcatctcttccgcttctgccaaaatcgttatctcatgacaccccgtctccagattccccagatcaatatcaatccagacacttctcatctgaccgggaacaggaatcaccatgccatcaaaaggcagcagcacatctggaaacatgcccgctttggtggtaatataattcgtatcatattccgcatagcagggataatccgaaggaaccagtcccaccttcctcattctcgcttctgcaccggatacctggatgcgaaatctctgcagcggcatccctctctctccatccagggcagtgtataccagctgaaaagaaaccgtttcattccggaatccctccagattccagcccggcttccaagtttccggtctgaaatccggaaataccttttccagggaatgtgtcaaaaagaactcataatgtaccatagcataaaatcctccttttattcttatcctttgattccgcttaccgcaattccttccacaaactgtttctgaaggaaaatgtacagaagaaatggggcataaaggtcaatgtggagcctgccatcaccaggccataattcgttgaatagcttcccttcagcgcagaaatcgcaagagtcagcgtctgcatctctggctttgtgactattaccaacggccagaggaaatcattccaacaggtgataaaggtaaaaatcgtcaaagatactataaccgacttaatcaggggtatcacgatagaaataaatatccggttctcaccgcatccgtcaattctggctgcttccaaaagctcatccggtatggtcaccataaactgtctgatcagaaaaacaccaaaggcattgataaccggcaaaaagagcgcagggtacgtattcatgaggtccagctttttcataatggtaaataccgggatcaaggttacctgtcctggaatcatcaatgtggcaagatagatgctaaaaagctggtcccgaaacggaaactttttttttgcaaaagcataggccgccatagaagagatgatgcaattgagcacacaggcggaaaccgtcacaatgatgctgttagtcagattagcagccagattgaaatttcggaacacgcggttatagttaataaggccgaaatctgcatctttaaagtttaaatccagaactgttttctgtgttaatgaaaccagcatcatatagataaaaggagccgtcgccagaagcgcagcaaataaaataactgcccccataatgattttgaatatccagccgttcttgtccgccttcctcatgctgtctcctcccctctgccctttaataacagtttctgcataaacgatataagcagtacaaatacaaacatcagcagggcaatggcacttgcataacccatgttatattccttaaatgctgtattataaattgtcagcaccaacgtaaccgtgctcatgccaggtccgcctcctgtcatggtatacaccagatcgaacacctggaaggaccagatcgtacccagggtcacaaccaggaacgtcacactggacaggccgggaagcgtaatataaataaatttctgtacgggcgaggcgccatcaacttcagctgcttcatacaaactccggggaatgttcatgattcccgcataataaattaccagaaagtaccctacattcttccagatactggtaatgcagatactgatcagtgaggtagcctttccgcccagccagttgatacgaggaatgccgaaaaatcccagcacaagattcacaacaccagtaggacttaacagaattgaccataaggtgccaaccaggatcgcggaagcgataacgggaatgaatagcgaacttttaacaaaattcccgaatctgctgcggaactgttctgcaataactgctgcgagtatcaacgaaagcatcgtctgaacgggtactgtgatcagcgtaaatatggctgtattcttcaatgacgcccatatataagaatccttaagcatcctggcataatttttaaggccaacgaactgtgccggctgcatgacattatattttgtaaaactgaaataaacgttcatgataattgggattaaagaaaagaccataatcagtataaagctgggcagcacatatgcgataccggttaaagcctctttttgtttgctcttcatagacttcccttccttttgccttgataaagttctgcctgacgaatcagattccgtcaggcagagcatggaccattaattaatactttcagaatattctactgttttttgtattgcctcttccggtgttaaatctcccagcatcatcagctgcaaattcttgtataatgtatccataactttaaaggaaccatttgcaacaggcagagtatgtaagtattcattctgagtctcatacatatccttaaacgccggattatcattatattcctcatccttagtaatcggagggaatccggcaatctctgtatggaagctggacatcacggccgcagacgtgatgtacttaataaggtccactgctaattctttatttttacatgcattgcttacaatcagtgcatcggatgctacccatgtagcctttgtctttttctcaaaactggggataaatgaccagttgatgccggcatcagttaatacatctgctgattttgcatccatagaagctactgctatacggtcttcacagaactgggttctcacatcatcccctgacaacgccagactttcctctgtaagcacaccgtatttaaatttcaaatcataaaggaactgggctgcctccactgctgctccattgtccatcaaagcaaccttgctgccgtctttattatagatatctccgccggcctgccataaatatggatagtagatgttatttaacgcaccgattgccggatcagcccattcctgcgcaaaaggtataacatttcccaaattggcttctttcacctgcaccagcacctgggtcagttcatcccacgtctccggcagctctgtaacacctgctgctttcagaatgtccatgttgaaatatggaattctcgcattccctacaataaatggaatggcatactgtccgcccttcatgttcccctgatcaaagtagagataattatccttctcttcctgagtgaaataactgtctacatctgccagtgttcccatttcaataaaatcattgaacatctccagatacatatagcctacatccggaccttcgccggaggagaagcctgtgagatatttttcttcataattaccccacggtgtaatttcaattgacagttttacattgttctcttctgcccaaggctctaatgttttagtccagaattccttatccagggaatctccggtcccaaatgggggcatccataacagaagatttgtcttctctcctttatccgctccttttgtgctgtctgcatcactgcttatactgcttgctgctgcacttgtttctccgcctgctccttttccgcaccctaatagagaaacaaccgttattgccgtaaccaacaaaacacccaatactttttttgctttcatatgctcgctctcctatcctgtattctccttttattactgcttcgtaagcacccttatcttagcagattattttaaaatcttaaatgctccattttttatcaggttaagcatttgtcatataattcaacaaataaaactcgtattttatgtgctcaatttgcatttttttagtttttgattttcattttttgttattatgccgctttaattattgatttttattggccattatataaaaattgtatattggggcagtatgcaggcagctctctcaactccctgcccccaattctgagcggcaggctttcttactctttattgtaaaatgttcttctgcattataaatactttctcaagactatttttcacgtctttttcctaatggaccgtaaacgccttaactgaatctttcatcaaattccaaacagaaccgcctcccctttgaaggtgaggcggaatacgctcaaacacatgcaatgatacatctaaacctgcttgacaaattccggcagatggcgttccataaatatatgaaacgcaagtcattaagatggagaatatcatggtacgtaaaaataaaaaagctacaatatagaaatgtgatttttgtttaccaaaccaaggggctgacattaggggtgaactaaaaaagcacctgatggttgttccatcagatgcctttatatcctctttcctattaaataaacttgctgcctgataatccttaagccttaattcttcacatctcccacatcaaaatgggattcctttggctcctctttttcctctatccaatcggaaaggccgtcttcctcttcctttgacttattcccgttttcagaatccttatcctcttcctttggctccggaattccctttgcctcccggaatattttcataaattccttaccggtaatcgtctctctttcgatcaggaattccgcaattttatccatcacatcacggttttcagataaaaggcccttagcctcttcataagcctcctttaacatcttcatgacttcctcatcaacctgggaagcagtggcttccgcacagttcatgacagtccgtccgcttaagtactggtcttccttggttgccaatcccataaggccgaatttctccgacattccgtactgggtgatcatggcccgggccacctttgtggcctgctcaatatcatttgcagcgccggtggtaaccgtgtcaaagacgatctcttccgccgcacggccggccagatagcctaccagcatagcatgaagctcttttctggaatttaagaacttttcttcctccggtacatgcatgacgtaccccagcgctcccatagttcttggtactatggtgatcttctgtacaggctctgcatccttttgaagggcgctgaccagggcgtgtcccacttcatggtaagaaacgatgcgccgctcttccttattaagaacgcggtctttcttctctttacctacaagaaccacttccaccgcctcaaataaatccttctggcacacggaatggcggccgttttttacagccaggatagcggcttcattgatcatgttggcaaggtcagaaccaacggctcctgaggttgccagagcaatggaatccaaatcaacggtatcgtcaagaagtacatcccgtgcatgaacctttaaaatatccacacgtccctttaaatccggcttatctacaatgatccggcggtcaaaacggccgggacggagaagggcgggatccaggatctcaggacggttggtggccgccagaaccaaaagtcccttggaggaatcaaaaccatccatctctgaaagcagctgatttaaggtctgctctctttcatcatttcctccgccaaatttggaatcacggctctttccaatggcatccacttcgtcaatgaaaataatacagggagcggattcctgggcctgcttaaacaaatcgcggacacgggaagctcccacgcctacaaacatctctacaaaatcagaaccggacagagaataaaagggaacatgggcctcacctgcaaccgccttggcaagcagggtttttcctgttccgggaggtcccacaagaagggctcccttgggaagctttgccccgatttttgtatattttccgggattatggagaaaatctacaatctcagtcagtgattcttttgcctcatcctctcccgcaacatccttaaaggtaattcctgtttccttctgcacatagaccttggcgttgctctttccaacacccataagtcccctccgcctactctgcgcatcatgaagtttaaaaggaatcccatggctgcaaataagagcagataactgacaatggtctgaacgaaaaagttgccgtcccggcgggttcttaaggtttccactccagcggtccgaagtcgttccgcaagatttaaatcgttgtccatccttaccgtataataagtaactccaggcttatatccctcccaggtcttcttgggatttatggtgatctttgaatcctctacattaaccgattccacctgcttttcatctaccatattcataaaggtgtcataactcagttccttattggtcctcgttgtaatcgcgttgtgcaggtaagagatccctgctaccgcaataagaaatgcgatgacccatatggcaattgcctgggtattcttcggcatcttgttattgttattattattattttgattcttgttatccatctgtgtgaattctccaatccggatagattctacccattctatacctctatcattatagtgtcagtctccccataaatcaagaaaagaattataaaatccttataaacacccaggctggttttatttaacagcaatgattttttttaacgttcttcccggaaataagcctgccccagacttgccggcggctgatgttcccttttctttcttaaactggtaataataagtaccacaatggtaaccacgtaaggcagggccttgaatatttcctgggcgtcccggtcaagtcccggtatgtaaaggtaaagaatgtataatcccccaaacagaaccgaaccccagatggcattcacaggcttccagagggcaaagataacaagcgctatggcaagccagcccctgtctccgaatccattattggtccaggtaccgccggaatattccatgacaaaatacaggcctcccagtccgcttaatcccccgccgatgcaggttgccgcatacttgtaggctgttacgtggatgcccgccgcatccgcagttgccgggctttctcccacagctcttaaattcagcccttttctggttttgtttaagaaaaaggaaagtaagactgccagagcgatccccagataagtcagaaagccgtaggaaaacagcgcctgcccaataaatcccagctttgacatccccgggaccggtgtcttaaaggcggctccggtcactgaaacggaaatctgtcccacacctccggcaagctttgataaggagcctccgaagaaatttccgaaacctaccccaaaggtggtgagggcaaggccggtcacgttctggttggctcttaaggtaatggtcagaatgctgtagatcagcccgccaaaagccgcacataagaaggcacataaaaaggagatcaccacgcctgccagtccctttggatctgatgtggaattttcatataaaaatgcgccgatcaggcctgcaatgcctcccatatacatcatacccggaattccaagatttaagttgccggatttttccgtgaggatttctcccaaagcaccatacaggatgccgattccctgtccgatggccttttgtataaatataaccaaaaatcccatgtgttcctctcctctctacgctgctgcggactgttttctgctccggatcttcaccttgtagtcaataaaaaattcacagcccagaataaagaacagaataattcctgttattacatcggaagcattttcatttaaattgaactgagaagcgatctggcctgcgcctttttgcatgaaaacaaggaaaaaagataccatgatcatggaaaaggtgttgaacttgctcagccaggaaacaatgattgccgtaaagcctctgcctcctgctgtgctggtggatatggtgtggctggctccgctgactatgataaagcctgcaattccgcatactgcccctgacagggccatggtccttaatattactttctttacgttgattcctgcataccgggccgtgttggtgctctctcccacaacagaaatttcgtatccgtgtttgctgtattttaaataaagaaacatagctgccgcaagggccagaacgatcaccaggttccagccgtattccaaaccaaacagcttgggaagccagcctccctttgtggcggaattaatggttccaacggaattggatcctttggggttttcccagaaaatgatcccataggtgaccacctgcatggccacataattcatcatcagggtaaacagtgtttcattggtattccagaaagccttaaaaaaggccggaatggcggcccaggccatggcggccagagcgcttccaaaaaacatcaggggaaacagggcaaaggccggaagggaatttccaaaatggatcatcatggctgcagaagtaactccgcctatgagcacctgtccttccgctccgatattccagaacctcattttaaatgcaggggtgatgcctattgcaatgcacaaaaggaccagggtatcccggatggtcatccaggcccgcctctttgtgccgacagccccttcaaaaatccctttgtaaacctccaggggatttagtcctgtaagggtgatgattactgccccgcagacgatcaaagacagcagaaccgcagtcagtctgatgagccatgccttccaggattccatggtctctctttttgccatttgaaaaaccggttcttttcccttactcatttttgccacctcctgcattcatcatcagtttcccgatttcttccttggcagctgtcctgccatccacaatgccgcttatccttccgccgcacatgacaagaatccggtcacacagctccatgagcacatctaagtcctcacccacgcacaggactgctgttccttgttttttctgttcgttaagcaggctgtaaatggtataggaggaatgaatatctaagccccgcaccggataagccaccagaagcactgcaggagaagaagaaatctccctccccaccagcaccttctgaacatttccgcctgacagcctcctcacaggaacagcggttccaggagtcgcgatctccagctcctgaatgaggcgctctgccaaagcctttggagctttcctgtctgtaaagaaggagcgccctccttgatagcttcttaacatcatattatccgttaagtccatggaacctatgagtcccatgcccagccggtcttccggcacaaaagaaaaacggactccggcccttgctatttcagctgccgtcatggaagtcagttcctttactcccccggccgccggataatatgaaatggagccttcttttgccggtatcagcccggcaatggcctctaaaagctctctctggccgctgcctgccacacctgcgatacccaggatctccccgccggcagccgtaaaggaagcattctccagagtctttactccttccctgctgatgcaggtaagtcccttgacatccagccgtttttccggtgatattggatcaggacgctcaatgtttaaggttatcttctttcccaccatcatctctgttaaagactcttccgtggcttcctccgtggggatggttcctatgtaccggcccttgcgcagcacggacacccggtcagacaaggccagcacttcatgaagcttatgagtgatgatgataatggaatgtcctgcctttctcatgttgcgcagaaccgcaaacagccggtctgtttcctggggcgttaaaacggcagtgggttcgtcgaggatcagaaggtccactccacggtataaaagctttacgatctcaacggtctgcttctgggaaacagacatggtatagatcttctgatccggatccagctcaaagccatattttccggtaaggctgtttattttttccccaacagccttacggtccagaagctcctttcccggaagtcccaaaatgatgttctccgcagcagtaagtacttccaccagcttaaaatgctgatggatcatgccgatccctaagtcaaaggaatccttgggagaccggatggtgacctctttcccatcaatggcaatctgtccctcatcaggataataaatgccggagatcatattcataagggtggtcttcccgcttccgttctcaccaagaatggacagaatctctccccgctttacagacaggcagacgttgtcgttggcagttactttcccaaaacgtttggtgatgtttttcagttcaatggcataattctctttcaccacactaacctccctttcccacttcctgtattttccattctcttatttaaccgcaaaaagcggggccggaatctccggcgccgcttttaagcctgactcattcctccgtgacatttaattttcaatggtggtaatgccatcaatcaaaacatcaaatgccggcgcggaaccatgctcagactcatggaaataaccatcctcgatatattccacatcgcttccgtcctttttataggtttccagcgtttcgcctccaacagtaaaagcagaggtatcaaacacatgaagagtgcctgccttcagggcatcttccacttccttcaccttttcctctgttccgggagcgattgcgtccttattaagctctgttatggaatttgctccttccttgtagccctgacaccagtctgtgtcaaaggatttgccgtcaatgacgctctgtactgcataggtcacatatgggccccagtcaatggaagcggaagtaagtgccgttttcggtgcggtggctatcatggagatattgtagcccacacatggaacgccggcagcttcacaggcagtaggagctccggtggtatccgcatgctggctgatcaaaacacagccgtcggaaatcagggcatcagcagcctctttttccaaatcaaagcttgcccagctgtttgtatattttacttccatcgttgcttccggacagatggaacgaactcctaaaaagaaggaggtatagccgctgatgacttcagcataggggtaagcgcctacgtagccgatcttaaccgcatccttattcaccttaccctcttcgatcatctggtttattttaagacctgcaacaacaccggatacgtagcgggattcgtaaacattggtaaaatagttatgcatgttgcttaaaccgcttaaagcagcctgatatccggttgcatggcagaactgcacatctggatactcctttgcagcttccagcatataggactcatggccaaagctgttggcaaaaattatgctgcagccctggtcagccagatccatggctgcatccttacaggtttcatcctccggaacattccattttacgatgatctggtcatcagacaggcccagcgcttccttcatttccattgcacccttataatgagcagccgtatatccttcgttttcatcaccgatataaataaagccaacctttatatcttccttggcgatccctcccgtggaaacagcttcctttgtctctgccccagtgtcagcttctttctcagtttctgttgcctgtgcttccgtcttttctccggcggcagtggacggggctgcagaatttccgcaggctgataaagacagagccataagacttgccaaagccagacaaaccaatttccttaatttcataatcttctcctccttaaacataagttccggccaaatacaaaaagcgccaggttccgctttgggctcacctgacgcaattgtcacgaccttataaaaataaaatacacccccctagtatagacatccttttttctcctgtcaatcacaatcccgatttccttggaatcgaaacttatgaaggaacttattcctaagccgacacttaataatcaaaagtttttttcaatgctactagatttttttatcaaatgggtgtataatctcttttttaaaaatatccccataccattacaaaaggaggttacactgttatgtcagtgaaatacgtatttgtcaccgggggcgttgtatccgggctcggcaaaggtattaccgcagcatcccttggacggctgctgaaggccagaggctataaggtcacgatgcagaaatttgatccttacatcaacattgatcccggcaccatgaacccggtgcagcacggagaggtctttgttactgaggacggcgcagaaaccgatcttgaccttggccactatgaacgatttatcgatgaaaacctgacccagaattccaatgtcaccaccggtaaggtctactggaccgtactgacccgtgaacggcgcggggatttcggaggaggcaccgtacaggtcattcctcacattaccgacgaaatcaaaagccgctttcactgcagcaacagcaattcctctgaaacagaaatcgccatcatagaagtaggcggaacggtaggcgacatcgaaagccagccattcttagaagcgatcagacaattccaacacgaagcaggccacgagaatgtcattctcatccacgtgaccctggttccatatctaaaggtctccggagaactgaaaaccaaacccacccagtccagcgtaaaagacttacaaggaatgggaatccagcccgacatcatcgtatgccgttccgaactgccccttgatgacgggatccgaagcaaaatcgcacaattctgtaacgtacccaaaacccacgtacttcaaaacctggatgtggaagtattgtatgaacttccccttgccatggaggaggaacatttagcggaagtggcatgtgaaaacttaaatctcccatgtccaaagccagatctgaaagagtggacttccatgatcgaaaactggaagcatccggaaaaagaagtgacagtcgctctggtgggcaaatacatccagcttcacgatgcatatatttccgtggtggaagcattgaagcacggcggcgtcttccacagagccaaagttcatattaagtgggtagattcagagcttgtaaccgatgaaaacgccgccagcttcttccaggatgtaagcgggattctggttcccggcggttttggcagccgcggtattgaaggaaagatttcatccatccggtatgcaagggaaaacaacctcccattccttggcctctgtcttggcatgcagatggctatcgtggagtttgcccgccacgtggcaggctttgccgatgcccatacctcagagcttgatgcagacaccactcatccggtcatccatttaatgccggatcaaaacggcatcgaggacatcggaggaaccttacgcttaggctcctatccctgtgttctggacaaatcctccaaggcttaccaggtatatggggaagaactgatccacgagcgccacagacaccgctatgaggtgaacaacgacttccgtgaagccctggcaaatgcaggaatgaagctttccggcatttctcctgacggacggatcgtggaaatgatagaaattcccgcccatccctggttcctggccacccaggctcatccggaattcaagtcaagaccaaacaggcctcatcccctgttccgtgaattcatccgtgcggccattgaaaaccaataatccgccagccacggatataaaatagcaagtccggtctctctataagagaccggacttatttttttgcggtgaaaacattattttatttaaaattattaatttctttcatttttttcttgcactttttcaatcttctgtatataatataatgcaacgtgtatccacacgagagacagttgtatttgtatgagatacacataaaggaggataatcattatgaaattgaagaaagtttttgcagtcactcttgcagcatgtatgagcgccagcctggttgccggctgcagctcgggttcctcttcttccggttccggcggcgcaaaagtcgttaagatcggcgtattcgaacctaccaccggagaaaacggaggcggaggttttcaggaagtcctgggaatgcgctacgcaaacaagactcatccaacggttaagatcggcggagaagagtataaggtggaattagtggaagtggataacaaatccgacaagacagaggccgtcaatgcagcacagaagctgatgagtgaaaaggtttccgttgtgcttggaagctacggatccggcgtttccattgccgcaggacagatatttgcagatgccaaaatccctgccatcggtgcttcctgtaccaaccctcaggtaacacagggaaatgatttctatttccgtgtatgcttcttagatcccttccagggtacggtcatggcaaactacgccaacgacaacggagcaaagacagctgccgtcatcacccagttaggagatgattattcctccggccttggttccttcttcaaaacagcgtttacaggcttaggcggttccgttgtaagcgaagaacagttccagaccaaccagaccgattttaaggccatccttacaaatatcaaggctcagaaccctgacatcatttttgcaccatcctccattaccacggctcctcttattattaagcaggcccgtgagcttggaattacagccaccatcgctgccggcgatacctgggagaactccaccgtcatcgaaaacgcaggcagttctgcggagggcgtagtactttccaccttctttgacgaagcagaaccggctaacgaggaagcagcttcctttatctccggctttaaggcttatttaaaggaaaacaagcaggatgagatcatcccggctgtatccgcacttggttacgatgcttacctctgtgcattaaaagccattgaaacagcaggctccacagacggcacagctatccgcgatgcattaaagggcgtatcccttgacggcgttacaggaagcatatcctttgatgaaaacggagatgccaagaaagacatggcgttcatcaagaccattgaaaacggcaagttcaaattcttaacaactacaacggtaaaataatcaaatctaccgtgacaatgcagtcattaccagatgagtggggacgtatttccttccccactcgttccatttccacatgcagtaagccctggatttgctgcacaatacatactcaacagataggaggcatttcgccacatgagtctttcaacctttttacagcagtgcctgaccggtatctccctgggcggcgcttatgcgttaattgccattggctataccctggtttacgggatcctgcggctcatcaacttcgcccacggcgatatctttatgatggccggttactttatgatatttgccatggcaagttttccctggtacatctctattccagtggtattactggtcaccgtattattaggtgtaaccattgaacgggtggcttaccgccccttacgctccgctcccagaatgtcggtcatgatttctgcgatcggtgtctcctaccttttacagaacctggctacttatttatttacagctttgccaaaggggtatccggaaattccgtttctgaagaaaatctaccagatcggcggcctttctgcatcctttgtcacctttctaacgccggtcttaactctggtcattgtttacggactcatcatcctgatcaataagactaagatcggtatggccatgcgggcggtggcaaaagattatgatacagcctctctcatgggaatcaagatcaaccgtattatcacctttacgtttgccatcggttcccttttagccgccatcggctccgtactctattttacagaccgtatgaccgtattcccgttctccggctccctgcctggcttaaaatgctttgttgcggcagttttcggcggcatcggcagcattccaggcgccgtgatcggaggatttattctgggcctgggggaaaccgccctggttgccttgggatattccaccttcagcgacgcatttacctttgttctgttaatcatcattctcctgatcaagcctacgggactgttcggtgagaagacgaccgataaagtgtgaggtgcccactatgaagaaaaatgcagtttccaaaaacaaactttatactctgatcgctctcctggtcatcatcggcctgctggcattcttacaggctaacagcgcccagtacagctatcagatctccatcctggagcgaagcgccatctatgcggtagtggccgtttccatgaacctgcttaccggtttcacaggattgttctctttaggccaggccggttttatggcaatcggagcctatactgtggccatccttaccattccggttgacagccgggccagcgtttactacgtgggcggtattgcacctgccattgcaaacctccaatgtccctattggctggcccttattcttgcaggtgttcttgccgcagccatggctgccctcatcggcatcccggtcctccggttaaaaagcgattacctggctattgctaccctgggcttttctgagatcatccgggccgtcattgcggctccccagttaaataccattacaaacggttcctatggattaaaaaatatccccgggtttcctaacctttttgccgcctttggactttgcgccctttgtatctttttaatggtccttctcatcaattcctcttacgggcgggcatttaaggctctccgtgaagatgaagtggccgctcaggccatgggcttaaacttattccgctacaaggagctgtcctttgtcatctcctcctttttcaccggcgtaggcggaggacttctggccatatttatgcgttccattgattcaaagaccttttccattaacttaacctatgatattctgctgatcgtagtcctgggtggaatcggaagcattacgggaagcgtcatcggcgcatttctggtcactgcaggaagggaatggctccgtttctttgataaccctctggtcatcggcggatttgaagttcccttattccgcacaggtttccgtatggtcatcttttctatcctgctgatggcagtggtgctcttctaccgccgcgggatcatgggcagcaatgaattttcctgggaaggccttggaaggctgatccggggtattccggctaaatggaagaaaaaaagcaaagcacagaagggagaaaactcataatgtcaaaagcagaaaaaacggccgtcaatgtgcttcacatgcaggacatcaccatgcagttcggcggcgttgtggctgtaaacggtctgacccttgacgtaaaccagggagagatcgtggccttaatcggtcccaacggtgcaggaaagacaaccgcatttaactgtgttaccggtatttatgaacctaccttcgggcaggtggactttatgggagaaaccattctttccaataccccaaagggaaagatgaaaaaaatgtacctgggagaagtgacgccaaggcccattacagtgatcagcagtacgccggatgtgattacgaaaaagggcattgcccgtaccttccagaacatccgccttttcggacagctgtccgtatttgacaacgtccttatcgccaaacacatgcgggcaaaacagaatgtattctccgctaccctccgcttaaaccgtaaggaggaggaacggatgcgtgccgaagccactgcccttttagaggaacagaacttactccacttaaaggatgagatcgcctcttcccttccctacggcctgcaaaggcgtttggagatcgccagagcccttgcaacggagccgaagtttctgctccttgacgaaccggctgcgggcatgaatccccaggaaacccaggatttaacggattttatcaaacagatccgtgattcctaccatcttaccgtattcatgatcgagcaccacatggatctggtcatgcagatttccgaccgcatctatgtcctggatttcggcaagctgatcgcccatggaacaccggatgagatccagaacaatgaacgggtaattgaagcatatctgggggtgagcgacgatgctgaagattgataatttgcgagtgaattacggcggaattgaggccgttaagggaatttcctttgaagtgccggataagagcattgtgaccctgattggggccaatggcgccggaaaaagcaccaccctaaagtccatcgttgggctggtaaggccatcggcaggaagcagcatcaccctggatggggaagaattgatcggcaaggatacgcctgatatcatatcaaaaggaattgccctggtgccggaaggccgccgtgtatttccggatatgactgttattgaaaatatcaagatcggggcttatttaagaaatgacgatcttaaggagaatatagactgggtctatgatctgttcccccggctgaaggaaagaagctggcagcttgccggtaccctttcaggaggcgagcagcagatgctggcagttgccagagctcttatgagccagccaaagatccttatgatggatgaaccttccctggggcttgctcctctgatcgtaaaggatattttctctattatccgggagatcaacaaaaaaggggtaaccgttctactcattgagcagaacgccaacatggcccttcatacggctgatatcggctatgtgctggaaaccggcaggatcaccatgtcaggctcaggagataagctgctggcagacgagtcagtaaaagctgcttatcttggaaaaaagaaaaaataaacagaaaggctgcagacaggcggccccttccttatggggcgtcagtctgcagcctttctgtttgtttttgcctgtcattatcacgggatcacccgtcgtatggtgactggcttcctgtaattccaggaggagattttgatcccgctccgtcggtttgccgcatggacgatctgtcctttgccaatatacatggccacatggtcgatttgccttccgcttgcatagaacagcaagtcgcccggctccatgctggcagctggtatgacctcgccctcttcggcctgctgcctggaggtgcggtctaaatgaactccagcggcatgttccatcacatactggatgaaaccggagcagtccgcccctgtattgggattggtgccgccccaccggtatgggttccccacaaatccgaccgcatagttcacaaccctgctgcggaggtcactgcttttctccgcttcaggtatggtgtatgcgaccgtggcattttccggagcataggcataggctgtctgacccttgtattggatctttgcccatcctttgctgtgggaaatgaaagggtatgtttcaccctcgtgaaccctgcccagtatttcagaatccgtattcggtttgctgcggatccgaagggtctcagtatctacccggagcatcagcttcatgtcataataggcaattgctctggcctcttgtccggtggccagatattttccgtacacatacccggttacctgccctgactttattttataccagccattttcttctgacagcacgctgctgccggcgtggttttttaatttccctacgatttccgcatcgttctttggttctttcctgatgtttaaggaatcctccacaacactcaccccaagattctgaaagattgagttgaaggttccatacctcactttttcctgcgtaagatctgccgacccttctgctccctcccgatccatggattcctgatattgatccatgtaaaccgaaattcccgctactggcgaaccggttttaggagaagaatctgatttagcggcctgtacatctgctgttcctatccatacggcacttccgcatgcaatagcaaagcccagtaccttccatgctttgtcagtcatatgcactttccttcgcaagtttttgattgtaaaccagggagcctttggcctttccctttacaaatgagtgatctgctgatctgaaagggccttcaaataccgcatcccgtattcccggtccattccgatctgtttctttaattgctccagcccttcaaacttccgttcgggacggatgaaatgcaaaagctgtacttctatagtctttccataaatatcctcatttataccataaataaaggtttctgctccaattggagaaattccctctaccgtaggctttcttccgatattggtaatacctccataataagtaccatccacatataccctggacacatacacgccgaatacgggaaggtgcttctccggcggaggtatgatgttggcagttgggaatccaaggacagcccctccaatgtggttgccatggacaacggtcccatgtatggcatagggctctcccaaaagctggtttgccttttccatatttccggcatccagctgttctctgatataggtactgctgatatcccggtgatcggcccgctctttaggaatgacgatcagttcatatccataccggtctttccactgtaaaaggctgtccgcatttcctgctccacggtacccaaaggagcagtccgtgccaacgacaatgatcctggcattcatctggcctgccaggacctgctttacgaattcctccggctccatatgggcggtttcctctgtaaaaggatattctacaagataatcgattccgatcttttccagattattctttctctccagattggtggtgatgaccttttgggagcctcccgttacaaaggtgctgggggacatgtcaaaggtcaggacagcagtcttaagacccttttctttctttatctctcccatcagctttaacagcttctggtggcctctgtggcgtccgtcaaatttccccagggtcacgaccgcaggctcctggatctgaaattccctggttccagttatatattccatacttggtttcctctttcttgcccgtcttcccagggcatacagggatccctggaaggggtttcctctttcttgcccgtcttcccagggcatacaggtatccctggaaggggtttcctgtatgccttaaggcgttcctcccagaaataccttctgaggcttaagaagatttttctccctgtccggcccgtaaaccccgataaaacggtccttgctgtcatatacccttacaggtccgtcaggaagatgggaatctccctctgcctggtttctgcaaaaggaatttccattgtgcaccagcttgtcaaaatccggcttcatccaaatggccgggtattctgagaataccttgtccacggcaagaatgtgatcttccagagtcccctcatcccgaagctcctggatccgggaaagggtcaggctgtcctctaaacaaaacccggagactttcgtgcggagcagggattccatgcaccctccgcagccaagctttcgtccgatgtcatagcaaagtgtgcggatataagttcccttggagcaggtcactgtcatggtaacccggggaagttcgatcctgtccacgtggatctccaggatttccacaggcctggccttccgctctacttcttttcctgcccttgccagctcataaagcttttttccatccacctttaaggcagagtacatggggggatctgatcgtaatggcccagaaagctgagtacggcttcccttacctgatcttcctttacttggaccggatattccgccaaaacctttcccgtagtatcctgggtatcggtttccctgcccaaaagcaggaccgcttcataggttttggtcttatccgtcaacatatcgcaaagcctggtggcctttcccaggcatacgggaagtactccctctgccatagggtccagcgtccctgtatggccaatctttttctgctttaaaatacctctcattttcgccacaacgtcatgagaggtatatcctttttctttgtatacattgatgataccgtctgccatagcgcgtatctcctaatcaagctgttttacaatctgattggacagattgttaatcacgtcatgaacgcttcctgtcatggtacagccggccgcctttttatgaccgccgccgccgaaataaacggcaattttactcacatcaagatccgtagtggagcgaaggctgaccttatactccctgcaggagacttcatacatgaatatggcgcataccacaccctctgtgatccggagatgatcgatgactccatccatatccgcaccggtgacgccgtaaaaatccatatcctttttgctgatagcgctgaaaatgcactggccgccatgaaaggttatgctttccaataaagccctgcccagaatctggttctgaatataggttttccggtagaagctgtcatcgatgatctttggaaaatcgattcctttttccatcagcttccctgcaatctccatggttttccttgaagtgcagtcatatttaaacactccagtatcatggattataccggtataaatgcactccgccacttccctgctgatcctgttttcatccaaaaggccgtaaagcacctcgcaggtagaactggcgtcatcctgtacgatattttcttttgcatattttaaattggtaacgtgatgatccacgcagaggctcttttttgcggtagttaagaactttaatgtctctccgaaccggagtgtatcgctgctgtcaaggcaaaggcagaggtcgtattccttatcctctgaaaagtcgctgacaatgcggtcaaaattccttagataattaaactttgaaggaggaatctcaagataaaccacagcatccacttccgggtgatgttcttctaagtagttgtatgccgccagacaggaaccaacacagtccccatccgggcggacatggccaatgattgctactgtttttacatcttcaagcattgcgtcaaaaaaactcacaagggcacctccctattctctgatatcttttgttacctcatcgattaatctggacatatttactccatattcaatggactggtccagaataaatttgatttccggtgtgttgcgaaggttcactctcctggccagttcacggcggatatagccttctgcactctttaatccttcgatggtagcctttccggcttcctcatctcccaaaatactgataaatgctttgcagtattttaagtccggggttacctgggcggaaaccacggtggtcattggatgaattctagggtctttgatttccagacggatgatctcacttaactccctctggacctccatattaattctggtattctttatactgtttttacgcatgttattcctttcgctttttgtccgctgtttcaaaaagaccagcccggtgtaacgggctcatctctttaaaatccggccggaagattcctagcggggaacctccaccatggcataagcctcgatcatatcatcttccttgatatcattaaacttctcaaatacaagaccgcactcatagcctgtggcaacttcctttacatcatccttaaatctcttcaaagaagccagaggaccttcgtagatcttttcacctgcacgtgtgatgcggacactgcagcctctctggaacttgccatccattacataggaacctgcgatggtacctacgccggaggccgtaaaggtctggcgcacgatcgcatggccgatgatcttttcttcaaacacaggatcaagcatacccttcatggccgcttccacatcctcaatggcctgatagatcaccttgtaaagcctcatatctaccttctcccggtcagctatggattttgccgtcacatccggccttacgttaaagccgatgataatggcatttgacgcagaagccagggaaacgtcggactcattgatggcacctacgcctccatggatcacctttaccataacctcttcattggacagcttcacaagactctgttttaccgcttccacggagccctgtacatctgccttcacgatgatcggaagttccttgatgttgccggccttgatctgactgaataaatcatccagtgataacttagcctttgtatcttccagtaatttattctttccttcggaaataaatgtttcagcaaagcttcttgcttctttctcatgatcggttccaaccaggacttccccagcatttggaacatcgttaagccctaaaatctcaaccggcgtggatggacctgcctcttttaccctgcggcccttgtcatccatcatggcgcggacttttccgtagcaggaaccagcagcaaccgtatctcccacatgaagggttcccttctgtaccagcacggtagcaaccgggcctttgcccttatcaagctcagcctcgatgatcagacctcttgcccgccggtccggatttgcttttaattcctttacttctgcggtgagaaggatcatttccagaagctctttaattccttcttttgtatgagcggaaaccggaacaaaaacggtgcttccgccccagtcctcaggaatcagctcgtattcggataattcctgcttcactttgtcaatattggcacttggcttatcgatcttattaattgcaacgatgatctccacctcggctgcctttgcatggttgatagcttccacagtctgaggcattacaccgtcatcagctgctaccacaagaatagcgatatcagtagactgagcgcctctcatacgcatagctgtaaaggcttcgtgtcccggagtatccaaaaatgtgatcttctctccatttacctcaaccgtataagcaccgatatgctgtgtgatcccgcctgcctctctggatgttacattggtctggcggatagcgtcaagcaatgaggttttaccgtggtcaacatggcccatgacgcagactaccggcggtctggaaaccatatctgcctcattttcttctgcctctttcagcagttcttcaatgacatctacttttatttccttttcgcagagaacatcatatcccatggcgatctcttctgcctgatcataatcgatttccgtattaagggtaacgattttgccctgtaagaacagtttctttacgataacggacggctgaagcttcatcttctcagccagctccttgatcgtcagaacctccggaatggttatggtttttatctcttctaccttaggttctacatgcatcggaggctgaaccggaacctttaacggctttccgcctttggcctgtgctcttttctttgcctcgtcatctttatctctcttatcgaatctgtcgtttttataagcattcttagtagctctgttgctggtaggctttgcctgaataggagtatcaaaggaacctgtcttccccgcagcatctctgcctgtacgtggtccctgtggtcttgctccgcggttatctccgtcacggctgtcacggttgccctgatagccgccctggccctggggcctgttaccctggtagcctccctggccttgtggccggttgccctgatagcctccctggccttgtggccggttgccctgatagcctccctgaccctggggcctgttgccctgatagcctccctgaccttgaggtcttccgtcacggttgccctgatagcctccctgaccctggggcctgttgccctggtagcctccctgaccttgaggtcttccgtcacggttgccctgatagcctccctgaccctggggcctgttgccctggtaaccgccctgaccctggggtcttccgtcacggttgccctgatagcctccctgaccctggggcctgttgccctggtaaccgccctgaccctggggtcttccgtcacggttgccctggtagcctccctgaccctggggtcttccgtcacggttaccctgatagccgccctggccctggggtcttccgtcacggttgccctggtagcctccctggccctgaggtcttccgtcacggttgccctggtagcctccctggccctggggccttccgtcacggttgccctgatagcctccctggccctgaggtcttccgtcacggttgccctggtagcctccctgaggtctgtttccctggttatcacggttgccctgataaccttcctggccctggggtctggcatcctctctgtttcctgcattcatttctcttgactgttcaggatttcctgacaaagactgctccgtcacctgacgatttcttggtgccccgttttgtccggagccctgaaaagaacttccgtctcttcccctctgctgctggggacgctgtccctgaggtttcatctgcgcattctgcggcctgaataccgctgcaatctttttcttaggcgcatcagactcatctcctgccggagcctcggaatgtgccggcgcacttccccggccgtgaccacccacttcttttttcacaattgatgcctgttcatccgtaatgttagaagaactttttaaatttatattatgcttttccaagatatccaatatttccttactactgtcctttcccagttcttttgccagatcatatactctcatgctttcctccattctgtgcgcgctctgcagcacataccggtagatgtgaaaggtcctcttcacactcactaccgacctttgtattcatcagtttcacgactgcctttgcaaacccatgatccacgatcgcaagggatgccctcatctccttacccatagcgtggcccagttcatccttttccccgaaaaagtagattggaacttcatagtaagtacacatattggtaaacatcttcttggtattatccgaggcttccttagaaacgatcactaatgatgctttccctgcttttacggacttttctgtcatgaattctccgcttgcgatctttcctgcttttgtggccagaccaatcagattaagaatcttttgtctgttatccaaactgctccatctccttttccaatgcttcgtatacttctttcggaatcgtcatcttgaaggaacgttcaagccccttgcttttcactgccttcttaaaacattccagggaaggacagatataagctccgcgaccgttttttcgtccggttgcatcaagaaggatctcatcctctgaggtcttcagaatacgaatcatctcttttttatttttcatctcaccacagccgatgcactgtctgagcggtattttctttgtactcacgcttccatcacttcctgttttttattcctgataatcaccggccggttcttcttcccggtagtcattctggtattcattgccataactttcatacccggtccctgcctcctgataatcaagcccaagttcttcaaacagaccaagttctcttgcctgcgtctcactcttaatatcaatcttataacctgtaagccgtgctgcaagtcttgcattctgcccttcttttccgatggccagtgacagctggtaatcaggaacaatgacctgggcttcctttgattcttcgtctgcaacaacgcagatgacttttgccggacttaatgcattttcgatcagataagccggattttcatcccagttgataatatcgatcttttctcctcttaattcattcacgatggaattgacccttgcgccgtttaaacctacgcatgcgcccaccggatccacgttggagtcattggattttactgcaatctttgttctggatcctgcttctcttgcgattgccttgatctctacggttccgtcctttacctctgcgacctctgattcaaacagacgctttacaagatccggatgagttctggatacggaaattctcgggccttttggagtatcctttacttccagaacaaaaaccttaattctctccgtggccttaaatacctctccttttaccatctctgtttcgtttaggatcgcatctaccttgcctaaattaatgcttacatttcttcctaaatacctctgtacaattcctgtgacaacttccctttcctggcaataccagtcattaaaaagagattttctgccttcctcgcgaatcttctgcaaaattacattctttgcattctgtgtcgcaattcttccaaactttttggagtcaatcgggcagtggatcacatcaccgatgtcgtacttcggatctgccatctttgcctctgccagactgatctgcagcaggggatcttcaactgtttccaccacttctttttccgcaaatacattgaaatcacaggtttcacgattgatggtgaccttgacattatccgctttcccgaagtggttcttgcacgccgtaaggagagaattttcgattgcctctaacagggtgtccttactgatattattctccttttccagaatattcagtgcttctaacagttccttattcatttttttatcctcctaatatctcttactgtttagaaatcaaatgccagccggatcaaagcgatttccgggcggttcaacacaagctctattccgtcttcctgggtaatggtcacagtttccctgtcataggatgtaagcgttcctgtaaaatccttctgtttgtttaaaggcttatataacttaatatccacttcttttccgatgcttcttataaaatccttatcctttttaagcggtcttccaagccccggagaactgacttccagaatataactgtccgcaataaagtccttttcatccagccagtctcccagcctgcggcttatgatctcgcaatcatctaccgtaatgccgccttctttatctatataagcacgcagataccagcttcctgcctcttttacgtactctacgtcaaccagttcaaaattattttcttccataaggggcagcaaaaagctttccgtctttgcctcatactcttctctctttgccatcgttctcccacctttccaaacaaattgaaagagtggacttacgcccactctttatcgccaaactgtcatgttatcttagacagtataacaccgtttattcaccattgcaaggggtttttcttatttttccagcctttccgccttatgttccgccatttttattgacttttcctgtggctgggattaaaatcaggctattggaagaggaaacgaatgccattactaaggaggaacatctcatgatgaaaaaaacagccggtatcctgtccgggatgctaattctatcattattaaatgcaccggacgggtgggcatcttccttacaggcagcgcctgagattgtaaatgtttcagaatcttcggatcccttactttcccggaaggcttcctatgaaaaggagatcgcagacctgatcaatgcagagcgggagaaacagtcgctcccagctttcacagttacaccctccctgtccggcctggccggcataagggcagaagaggccagcctgtatttttctcacacaaggccaaacgggacctcctgcttcacggttctttctgaaaacggcgtggattatcaaagagccggcgaaaacctggcattgggacagggtactccagaagaggcggtaaaggactggatgaattctgatccccatcgaaaaaatattctgtcacaggattttgaagaaatcgggatcagctgttaccatataaatgagtccaattactgggtcctcatctttgtaaaacagcggctatagggcattttatattaaggagtggaaggcatggttcttcacactccttttttttgtacatatcataacactatatcagatcaaatctgtcaaataaggaggacccatgaagccaaaactggaagttcgcgggatcagttactcctatcattcccttgagggtgagacactggccctttccaatatatcatttactgcggataacggagaatttcttgcaattgtcggcccatccggctgcgggaaatcaacccttctatctcttcttagcggattactgacacctgacgaaggagaaatctgcattgacggcgtttcccaggcggaatcaggcgtcaatatcggttacatgctgcagcgggaccatctttttgaatggcgtaccattattggaaacgccgaactggggctggaaatccagaaaaagcgaaacaaaagctccagagaaaagctgcatcagatgctccatacttacggccttggaagctttgagcaggcaaagccgtctgaactgtccggaggcatgcggcagcgtgccgcattggtccgcaccctggccctggaaccggaccttcttttattagatgaaccattttccgcattggattatcagaccaggctttccgtctgcgatgacattagttctatcataaaaagcactcacaaaactgcgattctgatcacccatgacctttccgaggccatcagcgttgccgacagggtcatcgtactgacaagcaggccgggcaaaataaaagccatcatacccatttcctttggaaaggatgatatacggcctctgacacgccggaacatgccggaattttctgtttactttaatcaggtatggaaggagctgcagaaccatgattgaaacccatcccactctagctcagcaggagtttattgaaaaagaaaaacttcaccgccgcaatgtccggatatggcgcagcatgctgctggtactgcttctttccctttgggagctgtgtgcaagactgggcatgatcaatgatttcatattcagctctccctcccgtatgacagtctgcttccttaatatggtggcggacaaaagcatttttatgcacatcggggtgacggtgatggaaaccctcataagcttttcccttgtcaccatctcaggcctgctgattgccgttttgttatggtccagccgcagtatatcggaagtattggagccttaccttgtcatgttaaacagtcttccaaaatccgcccttgcccccattttaattgtatggctgggcaacaatataaagaccattatcgtcgcttccatttccgtggccgtttttggatgcatcatgacaatccataccggcttttcccagatagaccctgatatgatcaagctcatctattccctgggcggaaagaaaaaggatgtgctttttaaggtgctgcttcccggttccgttccccttatcatcagcaataccaaggtcaatatcggactttgtctggtgggtgttattattggggagtttttagcggcaaataaaggacttggatatctgattatttatggaagtcaggtatttcagatggatcttgttgtaatgtctattgtgattctttgtattgtatcggcgattttatatcaggggatttcattgctggagaagaagattaaattttagatttatcagaaggagctttttacctgttgattctatgcgtatattgccgcgctcaacagaataaagggtttccagacattgataccggcggccgatcggccgccggtatcaatgtctggaaaccctttggcgatagatatttaacaaaaatgcatcactgccgcccatctgctgaatgcctatttcatgtccttgccccactccttgccattggacttaataagctttgagtaccaatagaaggaatcctttttaatgcgtttcatactaagcatcgaaacatccttgcagttaacaagctcttcatcagttgtatcaatataaaccaaaccgtaacgcttcctgattccatttccggtcgataataaatctgtaaatgaccatggattgtaagcaatcacctcacagccatcttcgatggcaaggccgacattgtatatctgatctctaaggaattcaatccttgccgtatcatgaacctgcccatctgcatccttagtctcatttgttccaaatccattttcagtgatcatcataggaagtctgtaatggtcccaaagatatcgaagcgaatatctcatagcctgcggatctatttcccaatcccagtccgtatattcaacatacggattcgtacataatgcatactcacctggaatattgggccactgcatctgtcctttgatgccaaacttgttaaggccatactcctgtctctcgctgtctatctttgactcatatgctgtattgcttctataacagttaactgatatgaaatcaatttttgctttcttcataagttccatgtcttctggacgaatatcgggatgaatatcgtgagtttcccagtattttttaacaaaattactgtattcgccgtatacatacgtatcattccagatcttctcagttaattcctctgcattcattgctgctatctggtcacctggactgcaggtctttggatagatcggaacatagcctgggacaggtccgatttttcctccttcaaccatttcatgacagttaattactgcctttgcatggcaaagattcatgatatgattgatatcccacttttctctgtcccaatctgtacagccctcgcttgtgccaagccagtggccatagcagatctgcatattctgctcatttaatgacagccagtacttaactctgtcaccgaaattttcgaaacaaactttacagaaatgttcaaatgcattgattgtctttctgcttctccagcctcctaattcctcatacacccacacaggtaagtcataatgataaatggttacaatcggagtgatattatttttaattaactcattgatcaggctgttgtagaattcaacaccttccgggttgacctttccgtctgaatgaggaataattcttgaccaggaaagagagaagcggtatgaactgaaaccacattcagccataagagccacatcctctttatatctgtggtaatgatctgctgctattgagttatctgcatatggctgtttcttcctgctgtttaaatctatcatggccggtgttcttccgccatcagcagttcctccttctacctgccatgcagcgcttgatgcgccccacatgaaactttccggaaatttagggtcttctttataaaacatgttgtacctcctgtttttcaaaacaatttaatttactgcagacttcttttcagctcttttgcctaagaataaggttattgcaaaagagactgcaactgctgttaccattacgattaaagatacgataaggtttctgctggtcccgtctgggttaatgtaagcagggatcgaaatgaatcctggcgtagatacaacgtactgtgtcatacctaacagacctgcgaggagacctcctgcaccgccaccgatcattgctccgataagcggatatttctttacaaataatacgccgtataccccggctctgtaataccacaaagcgcagtaacaccggcaccggttgcaacactgcggacttccgcattctttgcaatcattgctgctgcaagacatgcaccgccaaccgccacatttgccggagccataccagtacagataagcggatctgaaccgatctcagctattaataagaataaaaccggataagttgcattgttcattccaaagaataccatcaagggagttgttataccaatgatcataaccgcaattgccggagctaccctataaacggtcaatacgccgtctgctaaccacgtacctgcaaggtttcctatgggccctagtacaatgagtgttacaggaaccgtaatcagcattgtaataagcggtacaaatatggttcgtaaatatacaggcatgattttctgtaaattcttataaatcactgacatgaataaaacgcccaggattacaggaaatacggttgagttgtatgctatctgctgaaccttgatgccaaagaattcgagtccttctgcattatttatggtggaatataacagtattgcgccaagaaacgctccaaggtatccgtttgattttaatttgtttgatgctgaaaaacctataaaaatgggcagtgaataaaaagccgcctggttaacagcatagaaaatcttgtaagccccatcctctgcagacactccgaagaatgttgtaagaagagttaaaactgctccggtaagaccacctgcaatcagtaccggaataaccggagagaatgtaccgccgataaatgccataatatttgcaaaaaaattctctcttcctgcttttatatcctgtttaacagcatctgtatcctgaatttcaccaccggttttgatgccatcgtgcttcttaaattctgcaaaaagcgccggaacatcttgtccgataacaaactggtactctccgccccggacaataagatcaatgacccctgatattttctttgcctcatctttattgatcctggtttcatcatgtaactgtatacgtaaacgggtcatacaatgtgtaacattagcaatgtttgattcgcctccgcaagtactgattatatcttcacatatctgtacataatctttttttgccataatctttcccctcttcttataatttgtttcccgatgtttttgccacaaattaggaattttacgataccctcatttataaattggaaattacatttgcgcgctgcatgaattccatggataaagtatatcagatttctgcaaaaccgcgggtttcataatatgaaaccaaatataaattccagtaattttgcttttattctatattgtatcggtatgatttttgatatataatcggggtatgaatgaaaataataaaaaacaacaaaatacatttagcctgaaaggatttaatatcacctcttctttgcttgctatcattaattattccagtgaagatgatataaactacgttttggcgaattatctgctggagcgcatagatgttttggataaaatcagtatttatgatgtaatcgattactgttatgtatcaaggagtacaattcacagatttgtgaaaagcattggatttgaaagctttacacacatgaaagataacatcagacatatgcgggttcattcaaaggcatttattgactttgttaaccagtcttcttttaatgactacattatgaattccatggtcgatatgcttaaggatattaatgataccattgaccagcagaatatcgggctgcttgtcgacctgattagagcaagccataacgttgtcattctgaattcagatacatcaagttcctctgccaaggaatttcaactggaaatgacttccttaggaagactgatcaagcttgttacaaatatatcaagcaacgcgggaattctttccacactcacgaaagatgacctgcttataacatgttctgcatccggaaattacgccataacaaccaaggatgacgttaaagatgtcaaggcgcacaagtttctgattactttaaaccatgcaaagcaatttgaggaatattacgacaccataattttcttaagcgacaagttccagtcctgtgaatacatttccaatggaatgcagaacgtttatacccgatatggcataaactattttttcgatttgctatttaacaactatgtgcagaaatatttgatataactgattgtctcttctgaattttccccattcccaaccatatcattttgtatccgctgttcattaagatggatatggcagtgatgagtattgtgattctttgtattgtatcggcgattttatatcaggggatttctttgctggaaaggagaattaaattttagtttttagaaggagctttaccttatggattggtatttatccataaggtaaagctcctttatttatattataaatatgaaatttataaatcataccaatattgataccatacaattacaaagacttatgttcatactggatatgaaagtatcaggaaacttttaccctcttatgtaacatatctgtataaaaaatattaacgtgaaacgatttcttttaacttcatggaacatctgttcaaaacagcctgcaatgctacaatccgttacatttgggcaatcttgtgaggatttaaaatattattagggtcgaacaccttttttattccgttcatcagggttagattcacttccggcagagattccctaaggtaaggcttcttggcaaaaccaatgccatgttctccggaaacctgacctcccagcttcctggccttttcataaactttctccatggctttgctcatacgtctttcccattcctcatcgcttaaatcatctttcagcatataggcatgaaggttcccgtctcccgcatgtccgaagctcttaattcttaactcacactctttttgcaggccgtgcagataggtgaccattttgttgaccgaacttcttggaacaaccatatcgacctcatccatgtaggtggtagagcctttgatggcttccaggaatgctcccctggccttccagatggaatcttctctctcctcagtatcagaaatcaaaacatctaaggcaccctgttccaggcagagcgttgcaataccgtcatatgccttttcaatttcttctgccgaatttccgtcaaattttaagagcagataagcgtctgactgtttatccagaaatgcctttcctaaatactgctctgcgtcaataattacttcccgctgcatgaattcaatggccgtgggaatggtctttgatttgacaattaaaggaaccgtattgattgcatgctccagggtagggaagggaatcagcaggctgatcaccatcttggggcggggaatcaactttaacgtggcctttgtaataaaaccgagagttccctcggctcccaccattaaatccttaagggcatatccggagctgttctttacgaccttacctccgaattccgtaatctcaccacttggaaggaccacttccaggccccttacatagtcacgtgtcactccatatttcactgcgcgcatgcctcctgcattggtgctgatgttcccccaatggtagcagatttttcgcctggatccggcgggtagaacagatcatgatcttccacataagcagatagctccatcagcagaacacctggctccaccgtaattgtcagattatcctcatccagttcaagtacctgattcattaatgtggtatcaatcatgattccatgttctattgcaacggatgaccctaccaggccggtaccggcccccttggagttacggggatgacattttcataagcatacttcattatttcagatatttcttctgctgattttgccttcactacaatgtcaggataactgctggtaccgcttaattcatcatggctgtactcttcattaataaaaccaccggtcagaatacgctcctcgtccggaatgatgccttttatgtaagcaatatcatcttgatctagttttttatattccatgatcatactccttccttctcttttatccttgcaatcagtttggggagaatatcatagagatcacctaccagacagtaatgagctgatttgaagatgggcgccttaggatcgttgttgattgcaaatatggtatctgaatggttcatgccggccacaaactgaatggcaccggaaaccccacaggtgataattaacttgggccttacagtacgtccgcttaaaccgatctgatattttgcatccagccagccggattctgccattggtctggtacatgccacctggcctcccataagatctgccagctcccggagcatgcttaaatcctcttcttttttcactcctcttccggcaaccaccagaacttcagaattctcaataaaggtctccttctcctttggcagaatatcaatgacatccacatgagagacaagctttcccttatggatatcacaatttacgatttctcctgatttcacttccgagcgggcaggggcattcatgattttataccggactgtagcgatctgaggacgatggctgggagtcttgatatgagccataatgttgccgccaaaggccggccggatctgggataaatcactattttcattcatttccagaatggtacagtccgcagtcagaccggttttcattctggcagccactcttggcgcaagctggcgtcctacggtggttgctcctaccaggatggaggagggtttcacttttttgataaaatcttcaaagactgctgtataaggctctattttaaaacgatccagctcctccttatcatacaggaagactttatcagctccgtaatggaggatttcttcacttttttcactgatatcctttcccatgaacagaacatatacctcctgcccggtaactgctgccatctcctttgcctttccgatcagttcaaaggtgaccggatgaacggcgccatccacatggtctgcataaacagcaattcccttccattcgtctttgttgatcccaggtttttttatgtcctccacatactctactgcgccttcaggacccttctttatacaaaggcggcacatcttgcaggcagcatttacaactacttttccatcctgctcctccagcgctccgaagggacagacttttatcaattcctgatgatcaggaattctctcctgatgtatgattaatcttgccatttcttcacctcctaaacaaatttcagctcttccatcttgtcaaacagctttttggcaagcacgtctcctgattcatcccacacttcctttttatcgtttgtttccggagggaatatcttctgtacctgagtgggcgatccgttaaggccgtaattcatttcatccttatccttcatatcatcaagagtaaggatctgaatctttctgtcctttgtctctgatttttttacgtaggatgggagtcttggctgaaagatatctttatccactgctaaaaggcatgggaattttactttagccacctctacttcatcaggaagatccatatctaccgtaattccgtctccttctaacttccggattctcaccacattggatacgcttggaaaatttaaccattccgatatttccggacctacctgcgcggtgtccccgtctgtggtctgcttgccgcaaagaattaagtcatactctcccattgctttaattccctgtgccagggtatagctggtcgcaaggacatctgctcctccaaaacgcctgtctgacaaaagcgttccatggtctgctcccatggaaaacgcttctttaatgacctgcatggcctgcggaggtcccatggaaataacgtcaacaatacctcccgttttctctttgatccgaagggcagtttcaatggcatacaagtcatagggattcatctttgaagccgctccgtctctttttaacacgcctgtaacaggatccacctcaactttattgctgtcaggtacctgtttgatgcaaacaaggatcttcattctttttcttcctttcctaataaaccctacttccaaaatacgcgatatagccggcaattataatgaaagcagcgctgaatttcactgcctggtttaataatttgctctcacttcccagcaaattggctgccgcagcgccaatggctatgctctgcggggatatgattttaccgatggtggcgcctacggtacttgacgcaaccagccagacctggctgatgcccaggtttgcagccgtctgagcctgcaggctgccgaacagaacactggaagaagtcccgcttcctgttacaaacgcacccagcgcacccacaagcggagctgtaaaaggataaaagcttcctgtcagtgccagcatcgtgcctgcaatggcggcaatcattccgctgtatcccatgatctttgacatggccattatggtcactatggtcatgattgttttccacatctgtttcatggtactgataaataccttccccataagcttaaaatccgctccctgtatcttaccgccgatcactgccgctgctgctatcaaaacccccggtgtggccagccagacaaacgtatatggttttgctccctcccctgtgtaaatggaaactgacgttttaacagcagaaagcatctgatttacaggggaaccattttggatgtaagaagtaaaaatacaaagattaaaaggaaaggcatccaggctttcactgcttccttaccggttattttattttttccgtctgatttattgtcctctatcccatattccggatctggatttttaaaccattttttcacaacacctatggtaattgccatggagcagatggaaccgatgatcaccggaagctctgccccaagaaaagctgctgcaaaaagctctggtaccgcaaaagatattccggaaataagagcaaccggccagactccttttaaggcctttattgattttcctatgatgcaaaccataagaaaaggtgtgatcaaaataaacggagtcaattgaagagctgctgcaaaagccacttccccgcctggaagttctgcgatctgagctgcggtgaccgtaggaattcctaccgatccaaatgcagtaggagatgcattggcgaccagacatgctgcggttaccgcaatgggaggaaagcccataccgcacagcatgcttgccggaattgcaattgcagttccaaagcctgccataccttccataaagcctccaaagcaccagccgatgatcaggagcagaatccgcttatccctggatactccggccagaatttgtttgatgcagtccatgctacctgttgcaatgcaaagattatatgtaaaaatggctgcaagaatcaccaggctaatgggccatagcgcaagagcgattccctctaagcctccggtcaggcaatttactaccggcatttgaaagaatgtcatagataaaacaacggcaattgccagtgcaatgggacaggctttaaatgccggaagctttaacaggctcaatgcaatcatgagccataaaataggtgccaatgccaaaagaaagatcataatattcataaatgccccccaatacaagtttcatggttctccctacagtgactgaatcttcttaatctcctctatgaggagagggatcaccttgactgcatcgcccacaatccccacatccgcaatatcaaaaataggagcatcctcatctttattgactgccacaatatatcctgagcccatcataccggatacgtgctgggtcgcccctgagatgccgcaggcaatatagagttttggcgccacaattttccctgactgccccacctgatgggaacggggcacccattctgcctcaatagccggtcttgttgcccccacaacaccatgacaggctgacgcaagcttttccaccagtttaaaattctccttgcttcccatcccacggccgccggatacgataacctccgcttcctcaaggtttacagcttctgccatttcttttaccacatcaacgatcctcgtgtgaacagcttcttctgatcccaccttctcttccacaatcttaccggtcctctccgccaaaaattcctttgcaaaggcccctgatctgacaactgcaactgccggtgttccctttatgacaagatcattgagaatcgacccaccgtaaaccgggcaggtaaagataagacgccggtctttgtctgaaacatccattacatccacagcacagcccgtgtgaagtgttcctgcaaccatggcaagaagatcttttcctgcaagagttcctgctgaaagaatcaggaaaggcttaaatttctctgccagttttgtaaggactgttccgtatacctccatctgataactctctttttttacgattaccgctttgtctgctcctgccataatggcagtacgggccgcatccaccagatctctgccgattaaaacagcaattacctcttctcccctggcttctgccagcttatgggcttttgtaagcacctccagcgcaccgcccacaggagtatcagaaacggtctcaacataaaccataatattttttccatctgaataactcatttctttctcctcctaaaagatcctggcctccgccatgactgccatcgcctgtgaaactgcctcctgcgggctgtccgcctttattttaatgcctgctgcccgctttgccggttcaaacacctggagaacctttagcatgctgtccgtttcctcagaaggtgttaattccttaatctccttttttctggcagccatcttacttttaatggtggggtatctgggatcgtaattaggcttttgaaccgtaacaacacagggagcaggggcttctatgatccgatagccctcctctgtttcctgctttattttcatcatgccctccccaggctccacctggattacattggttactgcaggcagggaaagctcattcgccaaaagaagtccaacctggctggaggcatagtccgtggattcctttccgcagaaaataagatcaaactttttacttagattttcttctatttcatgggctgccttccttaagatccttgcaatacttaaggggtccagagactctgccatttcatgctttaccagatatgcaccgtctgcacccacggcgagacagtttttcagagagttttttacgctttcattcccaatagaaaccactgtaatttcaccgcccaaagcttcctttaatctggcagccatttcaagggcataggtatcaaaggcgttcaccaccggcgtcaccctctccaaagccggcttttttgttgccggatccagagaaatttccacggagtcatcgggcacctgcttaatgcaaactaacatttccatgattgtcacgctccttctttatttcccaatgatattgcctgcaataacaattctctggatttcattggttccctcaaagatctggaatatcttcgcgtctcttaacagcttttctaccggatattccctgctgtatccataacctccgaatatctggatggcttccgtagccacctccatggcaatgtctgaagcatagcacttggcaatggcagattccatggtatgggaaagtcccatatccatcctggtcagtgcatgggctaccatctgacgggcagtctccgtcctgatctgcatatcggcaactttaaactgcatggcctggtttttaatgactggtttcccgaactggatccgttctttcccatacccaacagcctcatcaatgcctctttgtgcaatgcccgcagcaatacagcccatccaggtacgggcctgatccagtgtcttcattgcaatggaaaatccctttccttcctcgccgattaagttggaagccggtatccttaaatcctccagcacaacatcacaggtattagaggtcctgattcccattttgtcttcttctctccctgtgctaagacccggtgtaccggcttccacaaggaacatggacatcccttttaccccttttgtcttatctgtcattgcagtgacacaataaaaggaggcaactcctccattggtgataaagcactttcttccatttagtatgtattggtctccatcctttacagcagttgtcttgcctgctcctgcatcggagcctgcccctggttccgtcaggcagaatgcgccaagacctccttccaagaccatttcacacacacgcgctttctgttcctccctgcctgcaatcaatacgggttttaaggcaaggccgctggccgaaattgtggtagcaaagcctgcgtccgcaattgccatctgctcgatcaaggcagccacatccacacggcttaatccaggtcccccgtattcctccgggacctccagagcctgatagccctgttccattgccttatcataaatcatctttggccattctccggatacgtcgtattccttacacgcctcctttacttccttctcacagaaatttttcacatcctgtaatagatcctgcgcttcttctgatatcaaatatgccattttgctctcctcctggacaaataaatttttattttaaagcttatagcagatttttccgggattcaaaatcatctttggatcaaatacttccttgatgcccttcatcaggcacatgcttgtttcacctgcaaaagcttccagatagcccatcttaccataaccaatgccatgctcaccggaaataagtcctccgcattccgacgcttttttgtatataatatccataaattctcctacctgccgtttgaatgtctcttcctccatttcattggcacaggtatagatgtgtaagtttccatctcccgcatgaccaaagctctttatggaaaaatcataccggttttccagtgatttgacaaaagagagataggaaggtatctgatttaccggcactacaacatcacactcatccaatagctttgtttccgcctcaatggcttcaaggaaggtgcttctggcttcccaggcttccttctttttcaccggcgtatctgccaccaggacgtctacggctccttcctctaaaaccacctctgccgcctgctctgaaagttcttctaaaagctccagcttatcaccgtcaaaggtgatgagtaagtaagctccgatatcaacaccgtcaacttcctttggaaatacattctttcccagataccgctccgaggaaagaacaatttctttctccatgaactccagtgcctggggcttcaaaccggacatgaatattttaggcacagtcccgatgcagtccgtaaggttttcaaagggaacaataaggcttatggtttctttgggcgccggtattaccttaagagtcagttctgtgataattccaagggttccttccgagccgatcattaaatgaatcaggctgtagccggtagaactcttagaaacaggtgcacccagactgataatttcgcccgtaggaagcaccacggtcatggccctcacataatctctggtacagccgtattttacggccctcatgccccctgcatttgttgaaacattacctcccagggtggcaaatttctccccgggatccggcggatataaaagtccctgatgcttagcatcctctgcaagatcatttaacagaacgccgggctgtacacggacaacaaagttttccatgtcataatcaaggatctggttcatcttactcatatcaagtaaaactccgccgtaaatggccactgccgctcccgtaagaccggttcccgctccccttggaatcactggaacattgtttgaaaaacacaatttcacaatggcagcaatgtcctccgtactggtggcatcaattaccacatccggaatgccttttccatagatcggcatctcatcgtggaaataatcctcattcatctcttctttctcatgaaccctgcccggaacgattttcttaaattcctgtatgagttccggggtaactttgctgtaagttacttcttccatcttaattcctcctttacggtaatgacaaaggctgtctgctcctgacgattacggaaaccccgtcaggaatgaccgtaattttcccatcagacttacccagccagtgatctgccatggaaattgcttcttccacgctgcctgcataatccatctgcatgctacggaccatttccccggtagcccgggtgaccatgatcaccttatattttaagagaattctgcacagaatctgtgcctcccactgatccggcacggttttatcccggggcgtatcaagaaaccggttcatgattgcattcttatcttctcccccgcaaaggtattgtaaaaggactggcctccatggccgtcactgcagcttgataccatgatgatgacacccccaggattgcaggtggcctcagcggccgtcatgccttttacagactggtatatattctggtccaggggatatccgccgttggtagtgattacaatatccgccggaatggcatccactcctgagagctggtccacaaacttacagccttccttatgagcttcgttgaaatggcctgcataggcctttatcactttcttattttcatccagcactacattgacaataaaagcaagttttgcctgctctgcagcgtaagccatatccctttgtatgggatttccctccagaataccggttctagcatattgactgtcaataaactcagagcaatgatttgccatgaccgtcaccccgcttgagactcccggcagcacgctttttcttccgccggaaaagcctgcaaagaaatgaggttctataaagccttccgatataagaagatctgcctctgccgctatccggttaatcaaaagctttccccctgagggaagggtgtctatgaaaaccatatcctcatctttccagctttcatgaacaacaaaacggatatccgttctgtcaacaatctcctgaccgaacttatcaatgagttcctccctggtggtggatctgtgaaatccggtggcaatgaggattgtaagctgtgcctggggatttccttctttgatttcctctataaccgcaggtgctatcacttggcttggaaccggccgggtatggtcgcttgctatcatgacaatgtttttcttccccttaaccagttctttcagccttggggagtgaatggggtgttccatcgcttttcggaccagctcctcttccccatcatctgcctgatagctgtgagcccttgacataagtaacccgtttaatctgctgtcaggaatattcaaactgattttttcccttccaaagggcagctgcacaaccgccatatatctttctcctccctatccgttatcctttatactgataaaaaccgcttccggttttctgtccaagctttccgccccgtaccatcttcttaagcagaggatgaggacggtatttgggatctcctgtttccgaataaagcacctccataatggcaagaaccacatcaagcccgattaagtctcccagctccagaggccccataggatggttggctcccagcttcatggcgctgtcaattccctccggatctgcaactccttctgcatatattccgattccctcattgatcatgggtatgagaaccctgtttaccacaaagcctgcggcctcctctacctgtacaggaacctttccgatgtcagcggctattttcttgatttctgcaattatttcaggaggagtgttaagtcctgcaatgacctccaccagcttcataaccggcgcaggattaaaaaaatgcattcccgcaacaggccggtcaagccctgccccaagctctgtgatggagagtgaggacgtattgcttgcaaacattgcttcctttttgcatatatttcgaagttcctgaaaggtctgttttttcactgccatatcttcaattgctgcttctaccaccagatcacagtcctggcagatactaattacccctgtctgaattttagacaaaactgcatcagcactttcctgtgtcatttttccttttgcgactctccgttccagaccctttgcaattttctttttaccatttgctgcaaactcctcattgatatcgcataaaaatacttcatacccttctgtctgggcaaatgcctgggcaattcctgaccccatggtccctgcgcctataattccgactttcatcccatatccctccttctatgtttgtatgtgttgggataaatctcccctcgccttacttcataagaaacgttttctcttttctcttctcaagaaaggctttcatcccttccttttggtccagtgtctcaaagcagtctccgaaaagccgttcttccatggcgaccgcctgatccatatccacctgaagcccctcattgatggcttttttacaatttctcaccgcaatgggagcattatctgcaattccttttgccatcttttttgcctccaaaagcagctccttttgagggtacacgccattgacaaggccaatccggtaagcttcctctgcctttatatttcttgcagtaaatatcatctgcttcgccattccggggccaatgattcttgccagcctctgagtgcctccaaaaccgggggtaatgccaagacctgcttccggctgtccaaatacggcattttcagaacagatccgtatgtcgcagcttaagcagagttcgcagcctccgccaagagcaaatccatttaccgcagctataacaggagggggaaaggtttccagacggcggaagatatggtttcccctctttccaaaggcctctccttccttttttgtgaaggtgctcatttctgcaatgtccgctcccgccacaaaggatttatttccagctcccgtaagaatcaatgctctgaccgaagctgtgtcaatctggtcaagaatctggtcaagttcctctaaaacctggctgtttaaggcgtttaaagcattgggacggttaatggtaatgatactaatcaatccttccgcttcgtatgtaacaaattccatgtaccggcacctcatttcttccattattatgtcaaccgtctcattctcttttaacgatggttgcgcagcccataccgcctccgatacaaagggtagcaagcccctttttcgcattccgtttttccatctcatgaagcaaagtcacaagaatacggcatccggatgctcctaccggatggccaagggcaatggccccgccatttacatttacctttgacagatcaaactttaaatcttttgccacggccaatgactgggccgcaaatgcttcattggcctcaatgaggtcaaactcatccacagtcatattcgtctttttaagcagctttctggttgcagccaccggaccgactcccataatctcaggtgcaacgcctgcaagagtacctgcttcccagtatgccataggcttaacgcccagctcctttgccttttcttcactcatgactacaattgctgccgcaccatcgtttatgctggaggaattggcggccgtaacgactccctccttttgaaaggccggtcgcagttttgaaattccttctgccgttgttccaggccttggaccttcatcccggtcaaagacaagggtttcctttttcttcttgatttccatcggcacaatctcttcccgaaatcggccggattcaatggctgcacaagcctttatctgactggatgccgcaaaacggtcaagctcctctcttgtaatctcccactgtttcgccacattttctgccgttacacccatatggtaatcatgagatgcatcccacagtgcgtcatttaccatggcatcaatgagctgtccgtgattcatacggtatccgaaacgggcatcttttaaaagataaggggccatggacatattttccgttcctccggccactacaatatccgcttctttgcactgaatcatctgggctgccagattcacacagtttaacccggaaccgcataccacattgatggtaaccgcaggagtctccaccggaatacccgcctttaaggaagcctggcgggccacattctgtcccaggccagcctgaatcacacatcccatatagactaaatcaacctgatccggcatgacacctgcccgttttaatgattcacggataacggctgctcccatatcctgggaggaaccgtactcaaagctcctcccatggttccgatagccgtgcggcaggctcctgctaatacaactctttcccccataataaaacctcctttttcatcagatataacaatgtcataagctgcgtcccttataaaagctccttgtaaagggtttttccggacaggtttttaggaatcttatccacctggtgaatccctgctgccctggaatttatccttgtcatctggtaaagatgttccaggatcagctcctctccagatttctccctgagatccgtaaaaatgatcagactgtcatctgttcccacacaggcaaaatcacttccttcaaaatgttcctttaacagcctctctgtctcatcaagatttaccctgtttccaaacattttgatgaaacgtttttttcttccggtaatgtagtaataaccgtcctgatcccgttttgccatatcaccggtatgcaggatgcccttccactcatcttctttttttaaatcctcagggcagcaggcatatccaagtgctacattctccccttcatacaccagttctccctgggtatccggttctttgagttcttctcccttatcatcctccagccagaacctgcctcctggtatggcaattcccatgctcccgcatcgctccactgcttttccagcgggcagatatcccattcttgccgtggcctctgtctgcccatacataacaacaaattgctttcctgtcttttccgcataggaagcaaactccttatgaaggtttatgggaagctttcctccagcctgtgtcattgtccgtaaatcaggcaggtccatctggagaaacccgatccgtttcagaacctggtaggtatagggaactccgccaaaggatgtgccctttttttcctttataaaatcccaaaacggctgctctaccatactgcggaccgtaagcaaaagggctgcccccgctttcacgtggctgttgatgatggataatccataggtgtaattcatgggcagcgtggtaacaggccgttccttctcatggatgttaagatacttacatatggactctgtattggcatcgatgttccttccgctctgcctcacaagctttggacttcctgtactccctgatgttgtaagaagcaaggaaagctctccgtaaagggaaggagacagcttttccattctgcggcacaggcaatatccttgtgttttccatacgatttcacattcctctgcctttaaaagacaatcctccggtatatatagaaaagccgggcggtactcacggatcagccccatcagaagctcctggttcatgtgtttttccagcatcaaaggaaccacccctgtttttaagcagcccagatacccaagaagagatccaatggtattctggcataatataataatcagttttttccctccgatataccggtacagctcctctgcaaaagaatccagatcccggtatgtcaccgtctgtccggcatcatctgctgccagcatccggtctccgtatgatttttcttcctgaaacagacgcatattactcctcccagacaatttccctggacagcatcttaatcagatcctgcccatcccatacaagatccatgtttaaggcttcccctatgggcaccaccctgtgaattccatataaatggttatttataatataatcggtcagttcctccctgcggattccgtaatacgttaccgtttgaagttttctgactgccaattgcctgaccgcagtccggtaatctccctgatactcaaaaaacaatccgcaggtgccccggtaattttccggataaggaggaacttcagaaagcagaaccgtataaagcaggttatcgtattgctctgtccttaaaatttcctccgttatcatggcatatctgcataaggtctcgtattttttcgtggccttatgagggcttaactcataagcggctgcctctttcttaacggtgttccaccatcttctgcggatctgttctgtcctttccgtcttctccttctggttccatatgacaaactgagggctggagcaggcattctgatccatggcataagcatcctttacaaatccgtatgccagcgtttgatggacttcatcaggaatcgttccgatccgttttgtatccagaatgcagatggaataccggtccggaaacatgacctgcacggcatccggtcttaatttcattcctctgaccgattgtatggcctgatctcctccccatgccataagaccatcgcattcctccagccagcttttaatgattttattttctcttttacaggagaaaacagaaatccggtttctgacagaagaaaattccggccggctcaaaagattgtcaattatttcacacagtttttgatcctccttccggctcctggaagagatccgtaccgcgcagctatttccagccaatagaccgatgaccatgctgtaagcaaacagaaccgggacattggaagagacaatatgaaagatcacacctctgcccatgcgaagttttctatcctcgtaccgcatccgaaattcctccatatgggtccttcttaaccagaacccaaaagccgggatttcacggtacgtttcaaactcccttctccttttgcgtatttcaatagaaagctcttccagaaagtccataacaagttctgaaaaaggttttaacggctcagccttcggccggcttactcctgccagatatgtgacatcatccatcataggtatcactgcacccccttatctcagcctggtgtattctccccaatactttaaaatattttcccagacggccgcaggggcagtcatcctctcccagaatgattccctcatcctccgtaagtatggagtgcccggggtaagaaagggcaagaggggaaagtacctgtatgatccctttttccccatgggagcaaacgctgaaatcctttgcccgtctggttatgatatcggaatataagcttgcatggaggtgaccctgggaacattccatatagatactgcctgtctgttctgccattccataataattatggatttccttaatcccggatgcttccccgatcctctccttaaattcatgagaggaaacagattgatcctcaagctttttaaatcctcccccatggataaggattccttccgaaagatccagcttctgtccggactttgcaaggacctgatagaaatacttccagatcatataggtaaaaccaaatatcaggatcccttttcccccatagcgttccagaaattgccggattccatccatatcaaggttcatatcccggtccagtccataacagattctggaggaaaaaatggaaaatccaaggattcccgctcctctggctgaaaacaggtttctgtcttttaatacctccggactgtccagtaccagaaagggaagtctttcctctccccaaaagtctcctccaatatttgccagtgccctctgctggtaatctgccgtatccctatccagataaatccttgataccgtctgcccttttgttccggaagaagtcatggtcttaaatacctccctgcctggaatgctgatcaagtccatatccttaaaaagtccaaccggtagcatggggatctcttcctctcccatcagtccgcgttcaggaatcataaggtgtttcaaaaattgtccgtatgcatggcagtgttttctgtgataatacgtcaattctgtcagccattccccgtacatcagttttttctcatcctttgctgcggaaaacggcttcctgttcagaatgccttcataatccatcatgaatggcttctcccttttaaatcacaacaccgtattttgccaaaacttcctttcctttttcataggaggaaaaagccattacatccgaagtactgatgtggatatcaaacgtctcctccagatctgaaatcagatccatatgtcccagagaatcccatgaatgggctcctctgtatttcagaccgggaagctcctcttcctttacccttaaagcccggataaataaccggttgtaaatctccagatttgtcataaaacctcactccctttctcctgccacggcaaacaatgttttcatcatcatctgcctgcttctgactgtaagaactctttccccgcgctgatttttacaggtaccgaaaaaaagtccggtgtagcagctctcctgttcctcaaaggaaacaaaccggacggtaatttctaaagtgtccccgcaaaaagccggccgtatgaacctggtattgtgctccatgtataccgttccgcttccgggaagacttgttcccataagtgcggaaaccagggaatcaatgaatattccatgggccggcggtctgtcaaagccagcctttaaagcagcttgtgtatcctggtgaatactgcttttatctccggtcagcctggcaaacatttctatatcctctttcgttatggttctcgttgccgctgccgtttcatgaagatgcagcgttctcttttcctgggacagaaaaggtttttccccatttgttttgaaaagctcctgctccagctgtctgaagctttcttcatcccataccacagccaccttgtaacgtgcttttaattttttcatttccgcacatcttctgctgcagccgcagaccaccacccaataatcgcagacctggtctccttttgggatcacgtattcatgctcaggatttgtttctcttaatttttccacccgttttgccctgtcgtacacaggattgcagcctccgcagtacttaatcccaattaccatctccgcctccgaaaaccagactacttctgacattccagcatgctttgcaattccctggccacggtccctaagggcctgttgatatcactgacaatgcagattttacgctcaggaatctgttcatgaagctttatttccagaatatcctttgcctcaaggaacggtccggcaaactcctccggcacaaaaccgattccaagactctttcggataaccggaataattagatccatggtggccacctcaatggccggctgcatggtaaggccgcaggaacggtaaaactcctgaagaaagccaaaggtggtggtggtactggacaaagtgataagaggaagcttcacaacctctgagaggaacattttcctctctctatattcctcatacattcttccgcccaccagaatgctcttaaaggatttgacttcaactacctttaacctctgttcatagtcaataggggttgtaataatcgccagatctatctttccggctttcagctcactgagagtctgctccgtattataattgaagatattaagcttcacctgaggatactgttcctggaaaattttcagtttctccaccagataagaccgcatggctacctgagttacccctacattaatatggtcatgctgctctcccatcaattctctcagcttttcttccccctgcatcagttgtttgcatgcaggagccacatagctgtagagaagctctccttcggatgtcagcgtgacgccttttctggaccgtataaacagcttgcaccccagcatgctctcaagattctgcatgcaatatgtaactgatggctggctcgttaccagggcatttgccgctctggtgaaattcttgtatttggctacatagtagaaaactttataatgctcaaaattagcagtcataccatcacttctttcataaaatattcatatagtaaactccattgacaaaccgtccccctattggtagacttctatgcaaaggaggttactatggataccgcaattacacaaatcgaatctgttcttgacgcaaaggtaaggccctctctggcggctcacggcggcaatgtaatcattcaaagcctggaacataatgttttaaaggtcaggttaaccggcaaatgctccgggtgtcccgccgctcacagtacaaatgaggaattgatttcccttgaggtacacgcagcatttccttccatccgcgacattatcttagtagaagaaacgaatccccaactgcttgacatggcacataaaatactgcaccaccagctttaatacatggaaaatcagaacagctttgtttcctggcccgggatttgattccgggcctttcacttggtactcctacttcccctgctctctttctttgtctaattttacgtttctggtataaagccacatatcgaatgtgatttcaataaaattcataaaataaaagaaccaggataagaaaaacagccagtcatttccagcaggtgatgatccgtacagcaaaaactttctaacaattccaaatatgtatcccagccagataaaggcttcaaaagaaaggctttttccttttgccgttctggacacataagacttatgaatggaaaacggccaggataagccaaagcatacgatcataagcgtttccagcaaattagaaatcataatgatattcatatatcccctcctccatttacattacaccaaaagcacttccccaaatcgccgttcaaattctccggataattcttcccggaaggccggtgcagcaatctttatcagttcccttgcccgttcccttaaggattttccttttaaatgggcaattccatattccgtcacaatataatccacatcgtttctgctggtggtaaccgctgccccctctgtcagaaacggcacaatcttagagatggttccaccctttgtggtagcaccaaaggcaatgattgaccggccgccctttgaggcagaagcccctctcacaaagtccatctgtccgcctactgccgaatattgctttagaccaatggcttccgcacatacctgtcccatgagatcaatctgcaatgcggaatttatggacaccacattatcgttctggcttatgacaaagggatcgttcacatagctgaccggcatcatgcaaatggcaggattgtcgtgtacaaaatcatacagccttctggtacccatcataaaggttatgaccattttttctctgtcaatgtttttctttttcccggtgattgcacctttttcataaagatcaatgatgccgtcggaaatcatttccgaatgaatccccagatctttcttatctcccaggaattttaagactgcatccggaattgctccgattcctaactggagacagtctccatcccgcacaagtccggcgatgttttctcctatcttttcctcaaccgctccgatgaccggacggccgtgctcatgaatcggctcattgctttccacaatggcttccaaattgctgacatgaataaaattatctcccatgacccttggcatattgggattgaccgctgcgatcaccttggtgcccggctgttctcccacttctttcgcaaagtcacaggaaaggccgtagctgcagtaaccgtgttcatcgggcgttgataaggttactaaaaatacatccgcagaagcagtctgggttacgtaatttggtatccggttgaagaagcaaggagtgaaatcgcccttaccctctgctatatagcttctgctgcgcgctcctacaaacagggaagtatatttaaaatgtttctccataccaggttcaaaaaacctgcaggcccccatatcatgctgctgaacaatatggatgccctttaaatccttctcagccgcataatcaaccattgcacttacaagcccatccggttctgctgctgcatgagcaattaacaccgtatcccctgaatgaatgatttttacagcctcctgaggggatttcacctttgaagcatagatctttttccagtccacgtagctacacctcctgatatttttcggcaaaacgtctttcaaattcctccgccaatccgtccttaaactgaggcgctgcaatatggatcagctgacgcgctctttctcttaaggtattgcctttcattttagcaattccatattctgttacaatataatccacatcatttctggaagttgttaccgtagctccctgggtgaggaaaggcacgatctttgaaatggttccttttttcgcagtggcaggaaatgccaatatagctcttcctcctttcgaaaaagaggctcctcggataaaatcgacctgcccgccgattccggaaaactgctttaagcccatggcctcagagcaggcctctcccataagatttacttccaccgacgagttaatggaaaccagattatcatttcttccaatgatcgcaggatgattgacataatccaccggcgccatgtacaggccgggattatcgtctgcaaaatcatagagcttccgggttcccataagaaacgataccaccattttatccctattaaaattctttgcgctgcaattaattactccatgctcataaaggtcaatcacaccatctgaaatcatctcagaatgaatgccaagatttttcttatttccaaggaattttaaaaccgcatccggaatggctccgattccaagctgcagacagtcaccgtcatgcaccaaagatgcaatatgctctccgattgccatctcaacatcgccgatgtgaggaagcccaagctccggaatcggagtatcatcctctgcaatcacatcaatatcactcacatgaataaagctgtttcccagggtctttggcatattggggttgacgaccgcgatcacctttgccccttctgcctctgctgcaggctttgtataatcgcaggatactccaaagctgcaatagccatgttcatcaggcagggataaggtaaccagaaccacatcaggcttcttcacattctgataaaagtaaggagtctggtaaaaatagcatggcgtaaaatccccgcggccgctgtttacgcagtctctcgtttttgctcccaaaaacaggctgttttctctgaaatgcttttccatgccaggctgtgcataaagggaatgccccatatccacctgctgaaaaatttcaatgccttttaaatcagcctttaccgcataatccaccattgtgtcgaccagcttcatcggttcccctactgcatgaccaattaccacacggtcaccggattttatgatctgcactgcttcttccatggttttaagtctcgatagatatatctctttccagttcatacttacgtaacctccccggcacaatattttattataaaaatatccgccataaatccagtcccatatgtttatggcggatattctacctcaataagccgcatacattcaggcttttatttaatcctcaattttggctatggctttagcaagctctttctttcttccaatgttgccctggcgggaaatcatgattctctgtgcctggggagaaccggcaccatggagagactcggttctgtatcccacggccgctgtgccaagggtcatattttcaatcaggcgcagaatccttaaacggttttctgtagagactccctcaactccctttaagtacttctccacatagcctccgatgacaggatcattcaaatccttttcagacggcgccgttaccataaggcctccggcaatgtcttctgccagacgtgcaatttcatacgggaatctggtaacgttctgcttacatacattggccagaagaaggtcaatgatgtaatttccggattctgttggagtcccttctgcggaacaggcaatgccgcagcaatacagggtttcatttaaatgagtcatttcaatcagcttatccttgatatgggaagccttaggcaccccattgtaatctgccgccaaagcggtggcaccgattaaaacatcccctacgcctaccttacacccgccgtaggactgtctgtggtatcctgcaaaacgctccaccagaacacctgcaaattcatattctccatccaggaagatgcggtcattgggaacaaatacatcgtcaaatacaaccagcgcttccactcctccgaattcgctgttgcccacatcgatctggcttccctccagctttctggtatcgcaggactgtcttccgattatcattgtgattccggccgcatccgttgggaccgcaaaggataccgcataatccttatcatcagggcccatggcaacggtaggcattacaattacttcctgggaattgataataccggtctgatgtgctttggcgcctcttacaacgatcccgtcgttttttcgctccaccactctcaaatacatatcctgatccggctgatcatgaggagccagtcccctgtcaccctttggatccgtcatggctccgtccacggttaaatcttcatcctgaaccattcttaaatattttttgaaattctcgtgataatgggttccatgctttttatcaatctcataggtggtggaccattccgcattaaatgcatccatacctacacaacgctgaaagcaggaagccgtcttctggccgcaaagtctctgcatctttacttttttcatcagatcatccgtacttctgtggatatttgcaaaccggttgatcttgcgcccatcctctaaagtcactgtcattaaatcttcatattccggcatctgggccagatcataagtggcctttacagaattaagtgacggtcttaaaatcggattgtcaatgggattatcaatttttttcccaaacatgtaaacattcagattcatcctgcgcatactttccacatactcttcccctgtcatcaaagccataaccatcttctccttttttaactttgcaggctgtcttccagcctttcaaagcgtgactgcaccattaagatcaaaatagctccttgtaaatcttaaggactctttgcccatctaaaggcacaaaattatttgccataagccttccctgctgctccatgacacactttgtaaacacctcaagatcttccggttttacgccgtattcatgaagaggctttttaggaagaatcgtcccaagaagctcatccagcttgtcataaacgtttttggtaccgcaccccaagagctttgccaggcgctggttcatcacggcaatttctccatcccggcgtatttccatataatttttcagaacgcctgtaaacatggcataattgctttctccatgagccacatgataagtccctccaagcggatagctggtggcatgaacagccgcacatccagcagttccaaaagcaattccagcatagttgcttgcaatcaggaaatccttcataatcggtatccttgcttctcttccctctgccgcaatcttctgatatcccctgataatcatctcaattgctttgtaaccaaacagctttgtataaggggtggcctttggagaaaggctggattccactgcatgaaccagtgcatcaatggagctggcggcaaacaccccaaagggaagtccaataagaagctccggtacaagcaccgcgtcatccgcatacatatgaggagataccaagcctaccttagtccccagtctggtccggttaatgatggaaatattggtcacttcacttccagtcccgcaggtcgtaggaagaatcaccaggtctcgtttcttttcaatcttctccggcgccttataaagagaatccatggattctcctgctgacacggccagaatctttgcaatatcaattaccgtgcctccgcctatggcgacgatccgtttgcagtcagtctttgctgctgcttctaaaatcgcgtccaccatgacatccgtaggctcacctgtaccataggtttcctgaaagattgtatgtacctttaagcccattgcaccaaaatacgggttatatatgtattcattggtcagtaccagatcatcgcttcccagattaaaatcctcagcgaattcagaacaggtttcgtaatatgaaatctgggattttaaaataacttccttcataaacggactctcctatgcaaaaatttcttcatcagacggctgtttccaatttttcctgacaaatgcgatacggctcttattcatcaagtgggtatagaagagattctcgctgatggcattattccccagcttccgcagccaagcgttgtggtaggattcaatgcatttgcaaaagctcccctgccatgctggaacaggtctggttcacaaccacacggcttacaggcagcttcacacctgcatattcgatatgtgctttatcatcagactgaatatctgccgagtggccttctccttctaccaaaaggttatcataagcaatctgcactgcctcttcccaggtcttatagctgtaggccgccatcattgggcacatcttttccttactccacaccacgccggcaccatgtctttccggtttaacgataatgacctttgttccctcaggaatggaaatgcccgccaatcctgcgatagtcttaaccgactggccaaccacgtttttattaataacgccgccagggaatacaacctctgacagactggcaactactgccggatcatcaatgtaataagctccctgatccacaaactctctgataatggagtcataatccttttcaggagcaatgatactctgggtgccggaacatatgattccattatcaaagatacggctggctatcatacggcctgctgctgccttgtaatcgattccttcatcaatcagtccctggacatttccaggcccaaccccatagcttggttttccgctggaataagcagatttcacaacccccatacctccggttgctatgacagcatcgcaggctgacatcagttccgtggtcatatcaatggtaggctcttctattaccagaaagatatctctgggaacacccatacggtctaactccttataataaagatctgccagctccatagcacattttttaccgcgggggtgaggggctatgataatggtattctggcatttgactgcgaacatggcattgcacatgggtgttacaaccgggttagtgcacggagtcgcagctgcgatgactcccatgggctttgctacttcgatgaggcctgcctcctcatctcgtctaatgatgcctatggatttctttcctttgagcgagttccagataattcttgattttcccttatttttagtgatcttgtcctcgtatacgcccattctgctttcttctgcagccagctttgccagcggctgggcatgatcgaaaacaacctttgcgaacatttttacaatttcgtccgtcttttcctggtcataagtgcataggatctgttgtgcttttctggaacgttctaccaatgactgaataaattgactcatttgggcttcctccctacctgctattagtgatttttttaacattgtttctgatactagtttaactctttttctcaataattgaaaatactagttttttatcataaacgataggatttttatatgtaactttttatgcattttatacaacattttataattctatcatggtatctctatattaatacgtgttttttattttgtttttattacctttattgacaaaaattctaagtaaaaataggtttaaaagggctgatccacagggttttctgcgaaaggatgacttaagttcttccttaaatccagtacttttaaccatattgcgaatattattgttataaaataaacaatgtctaaaaaatgatcctgaaaacagaaacgcctgcggaccaacggctctgttaattataaaactgaaaaaggcagattccgaagaacccacctttcatggcatagttgcaataaattattctcattactgtattacacaaaaaatcagcctgaattaatcataataattcagccggcggcgctcggccccacatagttactgtatttttttcttttttactctcactcataaagtgaagcccaaacaatggaaaaagagttccaactccgtgagaatgaagtcacttaatcccccagtctcctttttcaatcttctcaacaatccgcgttttacttcttatattctatcgttaaaccttttttcacacttccagccacaccttaaagctcctgctttcaaacggctgtaaaactgcggatatactctcaacttccctggttccggcatcctgctccagcatattgcagaccgtccattcttttatctggtaatctgattttatgtcaactttctgcctgctgcctgccgtctcatgaatccttatcaccaggcattcctctttctccgcctttttcaccgcatccacaaacacggccgggttatcggtccataacaatcgtttgcctgcaaatgttttcttctccattccctttacagagccaatcggcagattcaaattcacactttccggaatcgttccgccttccgtcaccgtcccggcgtgagggtacagagaataagtaaatgtatgtactctcatatccgcttttgtatcaggatattttgcgctctttaacagggaaattttaagggtactgtcctttgcgctgtatccatatttgcagtcgttcataaggctgactccgaagccgctgtcagagatatccgcccacttgtgtcccaccacctcgaacttcgcctgatcccagctggtgttgtaatgggttgggcgctccacatgaccaaactgaatatcataggatgccttggtgctccttacatcgaaatcaaaagccgccttcataagccggtgatcctcatgccagtccaccatagtttcgaaatcaatccgacggcttttcgcatacagaaccatgtcctgttcaatggaagagttccggtaaccataggagaaacggatcaccgccctcaccccgttattttccacgagtctcggcgcctcccttaccactgcagtctccatcttctgcatatagaacatatcaatatcccatgcatcataccgcatgggcctgtcttcaaagatttccaggcggtttccttctcccttcagcacttccctttcattttccctgtcataaacagaaacaagctgccctttctgattccagcggatatggtaatagggtgtctttacctcctcgttcaaatactccgccgtcaccttctgagcggcggcttccttttccggccaaaagcggatggtcctcatttccagcccacgcatttttacatgcaggaaaaagccttctccggttctgcctgatatgatgggggttccgtccaactcttcaaagcttccctcccttgtttcctggataaacacaaggtcattccggtcaaagctgctgaaattccaaagcatccagtgatcgtctgcagcctttacaagccggcttagaagtgtggctctcgtatcatttaacaggcggtctgcctcctggtattccttttccgaatcctggtaaacttcatgtatggaggagccgggaatgatatcatggaactggtttcgcaggacgatttcccacgcgtggtgaatctggttttggggatattccccttccactgttaatacctggctggccagccattccgtttccgccagtttccattccagctttctgttccacttcttgtttcccgcctgggaggtataggtgccccggtggtattctaaatacagttcgccgtcccataccggctgccagctcttattttcttccatatcctgatggatcttattgaaataatttccagccgtgtcattgaccacgtttggaacacctggaagtaaattcatggatcgcctgctttttaacatgcccggcgtcaccccgccgccgccgtctccatggccgaaggatatcagcacgtcctttgtcagatctttgtcccggaacttctcccagcttccaaatacctcatacggggtcagctttccgttataagtggcaccatgtttatgttcagaatcttcctgctcataaggcgtggttataaaataggttaaaatctcgctgccatcgatccctctccaccagaataaatcatgaggcatccggttgacgtcattccaactgatttttgtagtcgcaaacgtcttaatattgcactgccttaaaatctgcggcatcgcccagctgtagccgaacacatccggcagccagagatgggtgcattcactgccgaattcatccttaataaaattgcagccatgcagaaactgacgtacaagtgcctctccggaagtgatgttgcagtccgcttccagccacatgccgccgtctacctcccaccttccctcggtaatcctgtttttgatctgttcataaatctccgggcagtcctgtttgataaactggtaaagctgcggctgactctgcaaaaacaagaagtcgtcgttctgttccatcagcctgagcgcggtagaaaaggagcgcactgctttttcacgggtatgcttcagcctccaaagccatgccacatcaatgtgggtatgtcctacgcagtgtacggtgacctggctgtttttcggcatttgaaccagtcgttcctccagattctccaacgctgttttcaccgtgggataaaattggtcctgatcccagtcaataaaagaaaatgcaccgtcaagcgcttccaaaagcgcgccacgctctgtgcccgtatccggcatcagggctgcgctcttaacaatcccttcggtatggtaatagaaacggtccgccgccaaatttaagtatccgatgcctgccttcttaaaacggtgaatctggtcggtacgggcgccgccgccctccagcccggtccaaagcaggaaggtgagttcaatattcttgcctgcaaatgcctccagcactacctcattatggaatgtatccactccctgatggggctttccgtcgataaaaagcagcgattcgaaaccgctgttaaagccctccctgtctttccaaaatcgaaaataccggtaatctggctgccttcttttttctccggaaccttcacggttgtctgaaaccacagatagcggtcccttccgataaaaaaatcaccctttcggacctgttcatcttcgttcagacgccctgggtattgaacaatgacctcatccgcctcacagccggcatccccggcagcaaatggaaataaatcaatggtttcttcatacctccgatcccacagttcttttgtataagcagtcaatttctcatgaattaaaaacattctggcttcctttctgcattatagatcatgcgaaaacagtacattttttagtcttgtaaccagctttccggcatcctttttctgctgcatcacaagaaacgtcaccttttcctgagggcagttcacaaaacagcagccaagccatccatcccaacagtattccatctgccgtccaaggacggctgactgccatggattccacagaaccctcatataattcccatagctgaagccggattggccaaaccagttttcaaagccctcctgttggtttcctgacagccggcctctggtcagatattccacggcagccggccgaagaatccttttacctccaaggcttccattgttaagaagcattccggcgaacttctcatagtctccaatggtggagacaagccctgcaccaccggattcgaatctggcattctcatccatggcattcctgatccccaggaaatttcctgtgtattccgccaatccgccgtcttttcccgtctcatatgcctttgccagacggccctgcttctcttccggcacatagaatgccgtatccgtcatacctaacggctcaaaaatttcttttcttaagaagccgccaaatgactctccggtaactttctcgatgaccgctcccatgatgtcggcggaaataccatatttccacgacgttccgggctgaaacagaagaggtattttccctgccttcccggcaaactcctgtgttgtcatcggctctttttcagacagacctctttccgcctcatctaaaagctcttttgtccgggtctccgtcaaggtgcatgtatccccataagtgaggccggaagtcatatgaaggagatcatacagagtcatggggcgggccacatcttccagctgcaggtccaggtccatttccttggacacaggggcagcagacgttctgcttagtccattggttgaaagagtggatgccgctgtgccccggcatacctttcctcctgcaaaggacggcagatactcttccaccggagtctgcaggcaaatttcccccgctccagtaaaatcatggcagccacggcagttatcggcttagtcatggagtacaaacggaaaatagtatcccttccgatcttcttccccgcctccagatccgcgtaaccggcctccagatagcacagctctttgccgtctttggtcaccatcacattggccccgccaagctcccggctttccactgccttctggaggaccgctttcattttctgttctaattccctgctcattatgcgtaccttatccgttttcttttttatgattctgaatctgttccatataatccgatgggctgattcctacaaccgaggtaaagatccggctgaaataaaactggtcgttataacctgccctggacgccacgtcctttacatagacggaggtttcctggttcatgatctcctttgcgcattggatgcgtgccagagtcaggaacttattaaaggagtttcccgaatactttcggaacagcttgttcaaatatgtgggagacagcccaaattccctgcacagccgtcccatggaaaggtcctctgagagatggcggtctataaaagcggtgatccttccgaagaactcttctgtatccatcttctgctgctgcggttctttcttgatcttctgcgccagcatgttctggattgcgtccgaaacctcgtccaagtcttctgcataataaaagatatcatccagtattctttctccgttctgctccgtctccgacaacaggccgaatttgtccagcaggatcagaagataccgcacctgggcttccacgtacatctgtgtttttttcacacgtttccagtagttaaacagcccgcccaccgccggaacgatccggtcccgctgccccttttcgacggcgctttccagtgcacggaattcaccggaatcctttacgctcttctgcttttcttcctgcaattcttccgcaatcaggatctgatttacaccaataatgatgctgcggtccaggatctgatacagctcctcgaacacattatccgcatgttcgattaaaaacggagcctcccggatcacgcctgtcacataattggaattgccatgctccctgcggatagtctccgaaataatctgataaaagctcttataaataagaatatcttcaggataaagatacatggcttccatctcatcccttccatacaggaaaatcttctcatcctttcctgagaatatctcgaatcctgaatttcctgagtaccgtctgggaagcccgtttctcctcacaatcgccgcatagtatcttcccgccgggaaatagcgttccaggacttcctttctaacggtatttttctcacataggctcttcatcagctgatttctttttctggcatagatttcatcgaggcgctcccccatgctgtttaagacactttgaagcgtcgatggcttgatgggttttaacagataatcgtatacacctgaccggattgcggcctttgcatactcgaactcctgatacccgctcaccaccagagacagaacgtccggatatcgttccctggccttctccgccagtgcgatcccatccattaccggcattttcacatccgtgatcaggatgtccggcaggtcttcttccatccgttttaacgcctcctgcccatgctccgccgttgcggtcacttcaaactgcgggcacttgatggcaataatattgcagatatgcttgatggcagccggttcatcatccactgcgagtatacggtacatattataactccccctctttggacttacggattccaagaaacacttccgcaccctgttcgtggttccctacgcggtagatcagctgctccgaatagagcagatacagacgggcataggtattggcattccccattcccccgatctccagctccacatttcgctgaattgagctgatctgcaaccgcagcttcataatttcatcccggacgtatttcagcgattcttctgaaaatccgtctccattgtccctgatcctgatataccagccttcctgatcctgccagccggaaatctccagacgcataatctcgtagccattttcatagccgtgggatatgctgttttccaccagctgctgtaagaccagcttcggcagaatataatttctgatttcaggctgaatgtccatatggtactccagcttatgttcataacggcactttaaaagcttaatatacgcttccacgtagtcagcttccttttccacagtggcataccgctccttggtattggtcgaataccgcagcatggcggccagcccgtcgcagatatcacaaattacctcatcattatttaatacgcccctactggaaatgacatttaaaatattatagataaaatgaggatttacctgggcctgcagtgcgtcaaactgggcctgaagctggatcatggaggttctcttctccttcaagattgcgctgtccaagcgctttaacatattttcataggactgtctcagctgttcaatttcattattggatgttttcagctccacattttccgtgatgttattcagctttgtacgctccatcagtgccgcaagttcctgaaccggctttgccaaatgactggaggccgcaacggtatagaggatcgcaatggcgatgaagctggccgcaaggagcagtgtaattgtaaaaatatagtgtaagtcgctctttaccgcgtcgtaccgctccgccacaatgattgttacacccgtttccgccgataggctcccggcaagaaactcctcatctcctgtaaccgtattccggtatcttcctgcgctggcatccccctgtgccaggaattcttcataacccaaatcgccgtcatacctgccgttgctgaacagcagctttccctgtttatcgaacaaaagaactttaatctcaggattggatacctccagcagagccttcaaagagtcctcagtacgctgtacctcaatatatcccagattatctccctgaatctcctttataacggaatagacattctgtttcttctcccccagtcgtccacatgcagaccgatgaccgcaaactctccatagccgacagaatccatctccccaaaccagggaagcccatcgatgccggcacttgggtccatcttccgcttttcatgaattgtggataccacaacgccgttcctgttaaagaagatgacccgataaaaattacttatgatatagtcagtatttagtaaattccgcaccgccctggctgcttcgctgaaatacagggaaacataatcggcatcctttggaaatacggacagctttcgtatggcatccagggcatccacatcgcttaaaacgtaatggcatacatttttcatcgccttggccgattcctcatactgctggtttaattgtcttgatatgtcctccagattctgcagctcctgattcacggaacgcctgacgctggaatagtagaaaactcctcccagcaaaatggccgcggacagaataaacacagaatataccatgatcatccgggtgcgaaatttcataatgttttacccctttttgtcatttccttatactggacagacaacacgtaaaactttcccgtaccgtccggcttttctatcattagtctacaattccccttccgattaatcaagtacaattatttttcccgaaacagcagaagcttaacccggataacgtcttatcccttcacggaaccggccaccatgccgtccacgatcctcttgttaaagaacaggaacagcaccagcatgggaatcgtaatcatgatcacgttggcaaacagaagattataggaactggaataccgcccgataaaattaaacaatgtcagctgaattgtggcattctttgttcccggcaggaaatataagggattcgtaaagtcattgaacacggccactgcgttcagaatgatgacagtagacgtcaccggcttgagcagcggaagaatgatctttgtgaacatctggctcctggaacagccgtcaatgtatcccgcctcttccagttctaccggaatggagcctacaaagccgcggtaaagcataatggtgaacgggatctgaagcgcacattcgatcagcatcattccgggaatcgtcttatataaatacagccccttcatgacccagatcgtgggcagaatggctggaggcaccatgagccccgacaggatgatgctgtttgcaatgccggttaagcggtctctccttctttgaagcacatagcctgccatggagcagaccacgatcagcagagtaaccgccccgacagtgaggaccgcgctgtttttaaaggaccggatgagcagataattgttggcctttatcacctccagataattgtcccactggaacacctccggcagagacagctgcagtaaattggcttcccgtctcccctttaaagaattgacaaacatgaaaacaaagggtaccacaaatatcccgcctgccacaatcagtccgatgacatctcccaaaagccggattctttttttattcgtcatgtcagtctacctccctgctcagtaagaatttctgaagcggatatgcaagaactgcgatcatcaggaacatgatcacatttcctgccgtcgacaggccgtaatatcccgccgcatattgtttatacacggctgatgcaaccacctcggtggcatatcccggtccgcctccggtcattgcccagattaaatcaaagcttcgcatgcctccgatgaatgccagcatgataacggaattcatggccggcctcgccagaggaatcgtgatataaagcagctgttttaattttcctgcgccatcgattaccgccgcctcgtaataagtcttgtcgatcgcctgaattcccgcgataaagatcactgctgcgacaccaacacccttccatacatctgttccgaccacagaatacagcgccagcttcatgtttcccagccagtcaataccatgtactccgatcagttccagcaccttgttgatgagtcctttcgacggatgcatcagcgcggtaaacgtaatcccgaccgcaatggtggaaacaagattgggaaagaacacgacggagcgcagcagattctttgtcttaatgctgctggttaagaaaacgccgattaaaaaacccaccaccaccttgaacccacacgtaagtaccgcatagatcatcgtatttttaacacctgtatttaaggccctctctgaaaagaacatcttgaaattgtccaggccgcaaaatttcacttcattgaaattccagatcgtcagactgaaatacagggaaagaagcagcggtatcagaaaaaacacggtgaacacggtcatagccggaaccagaaaccatgtggaatatatttttttcttatccatttcattctcctccagttaaatgtccggcacgccggactcactttcctgtttaagaaagaacgaagcgtatcaccagaagtgaacgcttcgtctttcatcctcagtttacttccaatccagacctaactgcaccgcctgtttcttacaatcttcatcgtaagcggcagccgcttctaatggagttgtctggcctgttcccagttcctgacagattgccgggcagtcagcacccttgaccggtgtgataaattccagtgcaaggccggttttaccggaatcaaagtatttctgaagatcatatttaaccgcatcgtaggcattatccggtaattcgtatcccttcacgcagtagggtccttccggcagaagtgcggccgtgtagacatccagcgcttcatctgaaatcatgaattccattaatcgcttgatatcatccaccttgccggaatttttgtttccgtaccaggaggatggctcccatacggttaagccctgcttgtccggatcatcacctggaatcgcaaatgctcttacgttatttacatcatccccatacagttcatagatatttgaaagagcctgggagctggagaagtaatgagctccctctccgtttacgatcatgtcgcaggcatcattataggtggtcgccatgtaatcttcattataataaggtgtggtgtccgccagcttttcccagctgcgcagcccggcttcgttggtggcaaacttgatctcgccctgttcaaacttctttgcgaaatccggttcctgtaccatcacattatagtagtctcccaggaatgggaactgggtcgtccactgatccccataggaaccgatcagtgcaacctctccggcttcctttaatacatcacagttatgcagaaattcctcccaggtcttaggcacttctaagttgtatttctcatagacgttcttgttgtataagatcacgccgcccttggctgaggatgtgggaattccatataccacgccgtctatggtgaccgcctgcttatatgtatcatccagtctggccgcccagtcctcattggtgatatcaatgaaatactccgccggattgagcgcggaaaggagtgctccggaattggttccgcacagatccgccatatcgccggaagccagacgagtcttaatgatgctgtctccattgtccccgccgccgcgtacttctacttctacgtgaattccaagtttttcttctgccaaggcaaatacggcctcgtaaccggccggcgctaagtccgttcctatggaagcggtcagcgttgcttccttatactcccacccatcatcttctgtttttgctttctcagtggtctcaccggcggcttccgtggtcacggcagccgtctgatccgccttaggagccttctggtctgtcctgctgcatcctgccatgctgcctgcagctaccactgccgccatcatgaatgcgatcgttcttcgtttcatcgagtcaacctccctgttttttatgacctaattttagcacatcagttcccgttttaagaatggaaaatggcatcatgatatggtgaaaatttcgcacaaacaaaacgaataacgccctttgaaacgcttttctccatctgtagtggcggattatccataccttttgccaaaggaccggaagcggacatatccgattgcagggctgtgttaaattctccgtccaactgtggcggatattccatggacaaagtactttcattatactattcttaacaaaaaaattcattcatttggaggaaaccatgaaactggaaaataagaattgggtacagtcttcacgctcctgcggagcatcctatttcagaaaatcttttcagatacaaaaaccggccgaagcagcaattgccatctgcggtctcggcttctatgagctgtatatcaacggcagaaaggtaaacagcgactgtctgatcccagtcacatcagattaccaccccagggatatttccggctttctatatcccatgaaaggcacattcactcaccgtacctattatgatgtctattcagccggagaatatttacgggaaggaaaaaatgtcattgccgtcgaactcggtaacggctggtacaatcaaaaggagcggatcgtggagggccatcagtcctttggagagccaaggctcaccttccggctggagatcgccggagagcaggaggtgaccatcgtgtcagatgggaccatgcgccggcataatagtgaagtcacgttcaacaacctttttttcggcgagaaacacgacctgcgccttaagcttcccggctggcagtcccccgattttaacgactccctttgggaaccggcagtttccgtctctccgatggaaaccgtaatgtgccgttccgactgccccggcgataaaatgatccggaccctgataccaaagaagctctttgacgatggaaaacgtgccatctatgatgcaggcgaaaacttaagcggctgggtgatggtaaccggaaccttagaagatggagaaaccataaccatccgccacgccgacgagcttacgccggatggcgaactggacttcatctccagcggaggtgaagaacagattcagaccacagaatatatcggtaacggccgcatggaaacgatgtgccccaaattcagctggcaggccttccgttattttgaagtgactggcagactgtctgaatccggagatacgccgtttctgtgtgccgtcgtacacacggatgtggcacagacttccgccttccgctgcagcaatgagacgttaaactggctttatgaagcgtatgtacggacacagctttccaacattcactgcggagttccactggatactcccaacagagagaggcttggctataccggagacggccagttaggtgcccgcacaatcatgcttaccctgggcgtaaaacggctgtaccggaaatggatccgcgacgtgctggactgtcaggacaaggaaagcggccggatccagcacacggcgcccttccagggcggaggcggcggaccggctgcctggggtgccgcaattgttgaagttccataccaatactatgtccactacagggacatccagatcttgaaagaatgttttcctgccatgctgcactggtttgagtacctggaaaaccacagcgaaaacggcctcgtcgtttccggtgaacccggaggctggtgcctgggagactggaataccacaaaggagattctgcttccggttccctttgtcaacacatatttctatattaaatcactgcagaccgcctcagaaatcgccggaattcttggcatgacggatcatatgcaactcctggccgcgacggctgcgaaaaagaaggaggtcctgaccgcccactactacagtccaaaagacaacacctactgcggtggcgtacaggctgcggatgcatatgcagcggatatcggcctcgcaaatgacgctatgctgcacgcacttaatgagaaatacgcctccatgaatgaatttgatacgggaatcttcggcacggacatcctcatccgcgtattattccggtatggttatgcacagacagcctatcatctgctgacggcagatggtccgtcttcctttgaaaaggtccggcgcacaggcgccacaacgctgtgggaatcattcttagatccaaaagaatcgaagaatcatcccatgttcggtgccgtgacccgttatctgttcctgaatcttctgggaatcaaatactggggagatcgtgaaatcagcatcattcctgatatcgtagatggtctggattatgcggaaggaaagattaccacaatatatggtacaattgaagtaagttacgtgaaacgggaaaaagaaattgaatttctgatcaactgcagcgaagggattcatcctaccttgcattatggaggacggaagatgaggattgttcctggagagaaggttttgatcgaattagtcagttcaagcccggcattcattttttagataacacagcttttaatagaagcagagtcaaattcaattccggatttacctttaataatttaagtataaccggaaagaaaacaatgaaaatataggaattaagcagcatgtcagaaggggtgcaaaccccttctgacataagtaaatccacctactccaatatacctggccataaaacaagcgcgaagaagtgcctatatgctataccactcataatcataaaaatcaaaccgtgtaatcatactcagaaacactattataaccggaatctgatcctttctttaatcccagacgagcccactgctcctcaggcgcataattatccgccaatgcatcagacaacttcttctccatcatattccggatctccggatcagccacctccctggtttgtccgtaatcttcctcaatatcaaacaaatgatcctctttatgatagaccgcatcgctcaccagtgcgtttttgacttccggtattttatagaccggaaatggaacctgaggtaaaaagtacccgcattcaatcttttcgggtatatctttcccaagccagtccctgatcgtggtcaatgaggtggtatattcataacactgagtgttatctcttggccctcggaagtaagtatacttgccgtcaaacaaattgaccgataaaccgaaggtaccgtataatgcatactcccggcccttttcatgattttccacaattccttttacagattttcctgtaacacgttcaggacacgggatattctgataatccaggattgtaggcatgatgtcaatattctgggttatggcacaacgccgttctcctgcaaaggatgcctggggataatggatcaaaagcggaatgttgcagatctcattatagcacggcatatagctttttccgatatattcccgttctcccagacaatatccgtggtctgttgtaaggattatcatagtatcttcatacatgtttacttctttcagcttgtctataaattttccaaaatgaacatccgtcattgtcaaaagcgctttataccggtttcttaaatgagccattgcctcatctgtttcctcatcaattttgtggtacttgggcaaattaaaatgagggccatcgtaagtgtcgttgtacatatccagatacttttcaggaatgtcaaaaggttcatgtgggtcaaaggtttcaaccatcagcagaaaatcctcagcatgccggtttttttctacccagtcaatagctgcatcaaagcattgaacacttggataatcctcttccttcacaaattttgtccggttgcattggtactgtctctttacatccccaaaatacgtttccggcatgtatggatcatccattaacgaaatccagggatcactttcctggcctctgaaaaattcataagtattgaactgttggcaatagttctcccctccgatcctgaaataatgtgcatgatccgttatcatatgagatcttacaccattctcatttagtatctttggaagtgtttcatcaaaaatctcaatgggcccccaggatcgttccagaaaattcaaacgccctgtaaacaaatccctccttgcaggtatgcaaggaaggctgccggtaaagtgattgtcaaacgtacagctttctttactaaaaccggtaatattatctgcaatacaatctgtctgaggattgtagcatttcaaatgatctcttcgcagtgtgtccatcaatacgattattgtcttcatacgattcctttctattcatcctcacagctgttattatcattctcatactcattgatgtagataatagaatcctgcgcttcttttaccatgcggcggatttcctctggtgacataggtgcattatctgatgacagcaccgccgcaatcaccaaaggaagattcattccgcatattaaatggactttatcacttttatatgaaaaaaacttctgagttacgctgcctccgattatatccgtaaagataaacacttcatcatcaggcccgatatgtgtccatacttcttctatttgcttttggatatcaatgtcatccacgtaggcactgatctcatatacctgcggtgccttcgtcaaaaactgtacggtctgatacaggccatatgccatctgatgatgagatgctattataatttttctcataaacatgattcctcactatcctaaaattccaaaatacgctgctgccatacatagcactatgacggcaagtatcattccggtaataccgattttcttgcttttcaacgctttgtatactccaaacgtaatcaaaacagggaccagagacggtaaaactttatccagcataggctgaatctccattcccacctcaccaatatttaataccagcggtacttttacgcttacaaccgaagaaaccagggatccaactactgtcaggcccagaattgaagcacattcagttaacagcgatacctgcattccaaaagaagtgatcagtttcatcccctgcctgtatccgatgtggaagaaacttaccctcaaggccataaatgccacattgatcatcatccaggcaataacaccaacagcattattctgtaaagccatataaccggatatggaacctaagatcgtggggatcagtacccaaaatatggtatctcctacgcctgaaagaggtcccatcagacttgtcttaaaattttgtactatttccttatccttaattccgccattatcttcaatagccagagttgcacccaatattaaattggccagccatggcatacaattaaaatacttataatggttatttactgactccagatattcctgatcatctttataaattttcctcaaagcaggatttaaagcaaataccacacttgatgcctgctgggactgaaaattataggtattcattgccattaaaatccagcgcactgctacttttgtaatgtccctttttgtcaaaaccggattatttttattcatcttccaatccccctgaataatcagctcctgcacctgcaaccccaaacgaattatgatccgagtaatatttcatagccgctataataccaacaatcgtaactcctagaataggtacctgaagataagccgccaggaaaaaaccgccgatcagataatacatgtattttttcacaggcatatagttcaaaagcaaagcgatccccaccgcaggcaataccttgccggcaattgtcaatccctgactgaaccatttcggcataaaattcaatattccagtgataacatccggccccagccgcacagcaacgaatactggaattgcagcagtcagtcccataataaccggtcctgtaaacaggacattgatcatagatctgaattttttttcatttgcgtactgctgcgatttcctcccaacaaacccattcaggatctttgcaaatacatccagctgtacacccagcatagctaccggaagccctatggcaagtccggcctccatgccctttcccgttgttacagctatagtcgtagcgataaccgctgcagtggcatactccggcacactgcttccgccaatactcgctacccccagtgacatcagctgcaatgtccctcctatatataaggcagtctgcatgtctcccagaataaaaccaacaataaatgccgatatgatcggccacctgagtcctattgtcaatccatatttatcaattggtattaaaaatgccaaaagtgtaattaatattatttgccctgttgacagcataggtttaccctccacatcatttcgtattttttcactttataaatgaccccaatggtattttcttatcagctaagatatactgaacagttacctctgtgccgttactcattaagtaacgatacatttcaagctcctcatctgtggcattggcccgattggagaaaatgactgccgaatctctgccctgctctgttccgccgatatttaattttggaattgcaattcctgacttttgaaattcaacaattacattcggcgattttgcaataagaaatacagtttgaccgtcatacttatgatttttgtaattggtcagtgcagtttccaaagtaatgattgataatgcgcatcctgctggttttgctagtttcatactttcctttttcattacatcattggcggtttcatcgtctacaaccatgactctcatagcggctacgctcggtgcccactgagaagcaacaatgccatgcagcagcctatggtcaattcttgccagtttaatttccatagaaccctccttgttttagttaaaattaataaatttgtatatccatatgtttatcaatatatatattatcacctattataaatctttgtcaaccatttatggttattttcaatcatttggttggtttaatagtttcaaatgatcatttttggcattgatactataaattctttatgctatactacttgtagaatgattaattcaggggcataaattaatgggatttgataaaaggaagaatattatattagcacaattagagcagcagcctttcctattcttttctgatttggaacatttgttggatgtttctcctacaaccatacgcagagatctgactgctttagaaaaggagggttccatcatacgatttcacggcggcataaaaaaagacaagggtgttgccgaaatgtctatgaacaaaaagcagacaattcacgctgaccgaaaaaagttaattgcaaaaacagcggcggagaaaataaagcctaacagtttaatatttatcggttccggctcaacgacgttcgccatgcttaactatattcatgatacctcaatcactgtcattaccaacggaattccccatgccgaacttttaaacaaaaaaaatatacggacttttttattgtgcggatttattaaagaacgtactcgttccaccgccggtgagcagaccgtaaaaatgatacattcctatgtttttgattcagcatttctaggtgccaacggtgtgggcagccagctggaactgctatccgcagatgagtacgaacacaatataaaaaatgctgctatacaagccagtaattcttcctacattctggcagacagctctaaatttcaggctacagcaatgtttaatattccattacaggaacggcctaatatcttcatcataaccgaagattacggcggcagctgcagtcaaaacatcatcatcgcacactaagctaattacgtcattacattgtgccgggctaaatacaaaaattatacaggtcatacaatccatctaaaggaagggatttattatctccattttcatcggagaaatatcaggattgccgggtgtaaatggtacgggtaaaagaccataattgaatgtattgaagaaacagaaaaaatcagatggaggaacccatacccttttgaagaatgaatccacagatagagttaaaaattattcgagagcgttggcgttctattgaaaaaagaacaaccgggataacatgatgaagtttaattctaaattataaagggactgtgtccatgaatggcacacagtcccttttgtctgggattttgatcgtatttatcttccggtcttccgccggaaactcccaacaggaagcgtcctggatattccggcggcatatttttccgcaccgcgccccattgatcaccggatatgtaaatgcttcaaggtatctcccatctcctttatgcttttaaaaacagcatcaggggatatcgcggaaaccctcagatcttcttcttttgtttctccggtcagaaccagaataccagccgctccatttttcactccggccgccacatctgtataaatcctgtctccaacaaacgccatctcctttcggtcaaatcctgtcttttcttctaccatatcaacggtttctttaaaaggttttcccaggtatttgggggttacaccggtggaacggctgattgccgcgcaaacagaaccacagtccggaataaatccgttttctgtcggacagttaatatccagatgagtggccagaaacacagctccattccggatataagtacaggccttttccagtttttcatatgtaagggaagtatcaaagccaatcaccacaagttccggcatatcctgagtcaaaggaatgtctgcatttacaaagctttcttccagtgtttttgttcccatcagatatacctttttccctttataaaaggtattgatatactgaatcgtcacatctcctgatgtcatgatctgatctttgcttacataacagttcattttttccagtttctttctatagctttccggagatttcgaggagttatttgtaaaaaaacgtactggcgcccactatcttccacttcccttaaaaagtccagggcaccggaaagaatctgatcccccagataaaacgttccgtccatatccagtacaaataatttcgtttgattcaaaatttccctgttacccataattctctccaatttcatgattgccaaggctgatccaaggctttctcatcttttccggtcgtttattttccgaatatcttccggcttaaacttgtactgatgatccctcgtcaaaagtccgtttgattcctgttccacatcagtcagctgcgtataacaaaaaccattgatcaaatccgaatcatagattgcatgaatcaccctttcatactctttcagaaaatcagtgtccggcacagaggtatatccccaatcctggcctcccgcccgcattgccttttctccggtaatttcttcagtcttttctttctttatccggattccgccgcactccgtaagaacaatgggctgtccgctataggaaaacccttttgcataaggatgcttttccataataaaaggaagaccatccaccttcctgagacattctgcaaacagctgatgctgtttcttatcatctatgtcaccatgtttatagctatgaattgcacagatgtcactttccgtcatttcccagccatcattagaaatcaccagacgtgtcgaatccagtccatgcgccagatagtacaatgactgtgcaaaactctgctgttgtttattggcataaatttgaggtactccccagctttcattcagcaatccccaaaccacaacagaaggatgattataatccctttctatgacctccagccattccctggtaaatgccgcagccgcctgaggtgtataggaccagaaactagccataccttcccatacaaggaaccccagtttatctgcccagtataaaaatctgggatcttccactttttcatgttttctgcagccattaaatcccatagcctttgcttttaagatgtcattacaatattcctgatcatcaggagccgtaatcagaccttccttccaatatccctggtccaaaacaagtttttgataataaggctgattatttaaataaagctttccgtcttctacgtgtatttttctcattccaaaataagattccaccacatctgcccttatgccggaatctccttcttctacctggatgaacacatgatacaggaccggattttccggactccagtagtttcccataaaatgaaaggaaccttccattgctttttttcgaaagatatccacagtcagactgtttcttgccgtattgcaaagcatatttccgtgaaagatctcttcctctcccagggtgatgagcaaatgcactctgcatggcaaaattgacgtttcagtcagctgataatcgatgcgtacagttccctcatcaatatccgatgtaaaatgcacccatttcagacaggtttcggaaaccggttccaaccagaccgtctgccagattcccgtacttggggtataccagataaaactggactcctcttcccagaactgttttcctctgggaatcatttcatcttttaacggatcttcaatctcaacccttattgtctcttccgcccatgtcagatattcagcaattggaaatgaaaaggtcgtctgtcccccaatatgactgccaatacaactgttattaatataaaccctgcactgataatccacagcaccgaaatttaagagaatctctttccccttccatttctccggcacacaaaacctgcgttcataagtcacatgatcttccgttattctcttattgacaccacttttttcgctttggcacacgaacggaacttcaatctttgttttatcattaccatatataaaatcccaggaaccgtttaaattcatccattcgtttctcacaaagtccggacgggggtattcttctctcattgctattctccttacttaattcccgattgcgtaaagcctttaacaatatatttgttggcaaaaatgaagataaccatgaccggaagcaccgatatcacagtcgatgccatcatcattcccggatttgtgtaattttctcccaaaaccagggctgcaatccctaatgtgatagttcttgtttcattcctgttaatcaccagcgacggccacaagtagctgttatataaacctaagaatgtaataaatgcctgcgtaataacgaccggcttgactgacggcagcactatatgccataatacctggaaaacattggccccttccacgaatccggcctcctccagctcctgcgggaaagctaacagaaaattgtatatcagatatatgcacataactccggatcctgacggcagaatcagaggccagaatgtatttaaacctcccattaacttgaacgtataaaacagaggaaagtacgtcacaatttccgggactgccatggcccagatcagtgataccaaaagaaaactcttgcctggcagcggaagtctggccagggaataagcagccagtacactgactgtaattctgagtgctgtacctgctaccgtaacaatcaccgtattaaaaagccagaggagtatgggagatgtagcggtattcataaacaactccctgtaattatctaatgtccacgtcttgggaagaagagttttggacgtaacggattctgcaattcctttaaaactggtaaagaacataaacaaaagcggaaggagaaagatatatgcaaccaggcaggcaagaacaactaaaaatattttactgaaatttttttctttcataattccacctaccttaattcttctttttctttggtaagataatactgaccaattgaacaaagcacaatcacggtccccatcaatacggtcatggcacttccgactcccagatcatttctgtccataatggtggatgtaatcaccataatgaaagacttcgtcgtttcaccaggcccgcccttagtcatcagcctggtctgtccatatacattaaaggaggcaataatcgtagtcataagcacaaagaaaaatacatttttaatccctggaaaaataatgtatttaagctgtgtccaaaaaccggcaccatcaattgctgacgcttcatataactgcatgtctatttcattcagggcatttacaaacaacatcatattatagccgattgtccaccatacagtggctgctgtcagtgaaacccacacaaacggctgttgttccagccatgggaccgcttttttaatcattcccatgctgagcatcaggttattgagatacccgccgtttcctttcataagccatataaaaacggcggttaccgctgttaccgatacagaataagatacaaaatatatcgtccggaacgctcctctcaccttcccgggaagccggtccagcaaaagtgccagagccaggcttcccactacaagaaaaggtgtcgtcgcccctacaaaaatcagggtattttttagaccaagcataaatgccttatgatacatggaagaagaaaatagtatcttgatatagttatccaatccaacaaaaccctgatttccctttacaaggctgtacttagttacgctcatgataacgccatatacaaacggcataagccaaaacataataaaaaagataatgaaaggtactataaacaagacagccatgctctttttcttcataattttcctttactttctgtaaaccttgttatcttaactgaatctattgattactgttccgaaagctcaatagcaatatccgttgcattcttcagttctgccatcagctgatctccggttaattcaggttcctgaagcaccagtgcccaaactgttgagttaacatatttgacctgttcgcggatattataaattgccggaaggatcatcgcatcatcaaatattccgtaattaacatttgcaaccggatatttttccgggttgtccttcactttttccatggttgccagatggatgggcgcctgaccggaatctgcccagttaagcatcacatcaggctgatatgcatatttcataaatgctgcaataccatcaagttttttctggtccgtcacttcagcagatacaccgaacgtatgtccgccggcaggtacgcatggcgtatctccgtataactgaggaagaaccccaattccaagattgtcccccagaatttctttcgctgccgtgtaattccagggacctgtgagacatacggcgcttttaacgcttgcattatccgcagattcattcacaaaagtattgtaatgatcctggtctcccagcccttctgcactgaggtggtctttataaatcagattatgtaccttcataaacgcatcgcagatttcttcggtatccattttgatatgctctccttcgacccagttgcatccagactggccaagggcagtcatccatgcccactgctgatctcctgtcagaggaattccaatgggataaataccggtatttacagaatcaagcttatcgcgcagcgctatcatatcgtcataattctttggcggagtatcaaccagctccttattatagtaaaacgtttctgcataaagatccaaagggaaggcaaagactccgtcatcatatttcgcataggactgggtaatcggatggaagtccttatcaaaagatattccagctttgtcatacaaatccgatacctccctaagaagtcccaaagcatgataagtggaaatccagtcagcatgaatgatcagcatatcaaaatgatcagacttaaattttgtataatgatcggcatcttgcagctgttctataaaatattgatcctgtgattcgttaaaaccgtctacgatttttctcataaaaggaccgtcgcccccggtaaatccattaataaaggtaatctttgtccgctcatctcctttttccgcatcggatgcaggtgctgtctcctgcgccgctgcctcagttttttccgccgtcgttttcgaagaaggggctcccccgcatgctgccagggaaaaagccatcaatgtggataataataataccgcctgtcttttcatgtttttctccttttcttttgaaattttacttgaaaatcctcccactatttattataataatactgtaataaatgagtaaccacttctcatttccagtaagattattactgtatttttgttaaccaaatagtatcatgttttgttttattcgtcaatatcgagaggataaattgttttattttgtatataatgcacaaattacctcattctcatttgttgtattttatttttttattccattttttatgtttttaataatcgattttaactccaaaaataatgtaataatgtaagaaagggattcctatgaaaaaacaaaaagctcctgttaagattattggtgaacgggatattgaattaaacctaagtaacctcgcccatcacagccatattatttcgattgggaaagcactctcctctccggttcggctcaatattttaaatttgttaaaaacaacccctctgtcaatacaggaaattgcttctatcttatctattcctgtatcatcaaccgccgcccatatcaaatgtctggaggaagcccgtatggtcgtgacggaaacccagcccggaaaccatggttccatgcgggtatgcatatgcagcatacagacatttactctggagacctttgattctgatttggatgttgtggataacaccatcgtagttgacatgcccatcggcaattattttcagtgtcaggttgaacccacatgtggactggcagatgaaaacggagccattgacacatacgacagtcctacttcgttttattccccttatcgcatgaaggctcagcttttatggtttcagcaggggtttattgaatatcgttttcaaaatctgatcaatcctttgctggatcttcatgagatttcattttctatggaattatgttcagaagcccccggttatctggaagattggccctccgatattacaatttcagtaaatgggcatgaaatcactacattttgctcgcccggcgatttcggagccagacggggacgtctgacgcctgctgcatggtccaatggaagaactcagtatggcctgttaaaaacgttttctgtcagggaagacggtggatacttggacagaaggctgataaatccggatctgcatatcggagatctggaactggagaaatacccatatatttctctgatcatagccataaaaaaagatgccagatatattggaggtattaatttatttggtgagaaatacggtgattatccgcagggaattatcatgaacttaatatattaatttgaaaaacaggaggaaaattatgagagacatcaatatctccacgattatcggaagtgaagtatctgtggaggaacaatttcaactaattaaagaaaccggttttaatggtgtttttaccacattcaccggcattgagcccattgaattctgggcagaggaagctttaaaaaaccagctgaattttgagaccatacatgctccgttccaatatgcaaaccggctctgggaagccggttctgcagggaaagagtatttgaattatttgaaaaccatcattaatgcctgccggaaaatccaggtagacaaatgtgtcatgcatgtaacagtaggcaacactgctcccaacgtttctgaggaagggctgaatctgtttgctgaattgtgttattacgcaaaatcaaaaaatgtacatatctgttttgaaaaccttgagccactcccacacattgatgccgtaatggaatacatcacagacccttttcatggtttttgctgggattgcggccataatgcatgctatacccctcacattgatatgattaaaaaattcggttcccgtctgaaatgcattcacatccatgataattttggagtgacacagcccgggaatatcgattatcgggatgaccgccacctgcttccttttgacggaattcttgactgggactggtatgccaggaaattaaatgagatacattatgagggaccgctcactttagagctttccatcttgggaaggccggaatataagaacattccccttgcctcctatttgagccaggcatatgaaagaggctgccgtataagagaaatgcttgcaaattgaaaaaacgccagccccaatcctattttttcatacccacaggtcttacagatggatctggcggtaatgagcatcgtgattctgtgtatggttaaattcaaaattataataggactgcggcactgaataactggtgccacagtcctgaaagccagcattacttatgttcaatcacttcctgcagacgaacgcttgaatccctgatgctgtttatggatgtacagatcacctccactctcccgtactgttccctggtcgcagccagcatctcatttgttgttgtgagctgtttttgagaaatagctgatatattttcagactgttcccgtatttgtgaaaagatatggcttacctggtccaccttgtccagttcattttctatgtaatagtttatcttatcaaatgctccccgaatatccccgaagctgttcagcacttgttttgttatgtatccgctgtcaaaccgctggtaattctgataatacatgacggtaaaggtaatggtgtacaccccgccaaagctgaataaaatcgatttgttcaaataaagcgaaaccacgctaagtaccgttgcaataatcattccggtatatggaccgccgatactggaaaccgtacaagtcaaaatagtcataaaaaggatcgccatggataacgtatgcttcctggtctttacaatcaatattgccgctgcggtcagctctgcaatcagcgattccagcactcctcctggcagttccataaggccaatccactgtagaagcagcgccgctataaaaatgatggtcagcaatcctattataattttattgacctttgccgtattcgctataataaagctgctttgtgcatgcttgcttttggctttacttttcttgttctccatttcccaccctccgtttatctgttttcttttgttatttcctgtatggcataatcaaagctttaaaccacattgtataacgtgtgtaccaacctgccacaatactccacttcactgcaaaactgatcaggcagatacaggtgtgctggttttctcagctgtaccgcacccgatgcatggagcagctctgcgacgaactgagaacagaaatagtggtttttccagataaacggaacatgaaaagtacagcaaaacaaaccgaaccgggtatacttgaaataactccggcagtcccgaaaccgctgaattgtcttctgaagcatggtatatgcctgctcagaaaccccggtaattaaaactataaaaatattgatcatcccctaatccgatcgatgcgtgtgtatatccacggtcactcaaaaaataaaggatatgggaaccagatccacatgcttggtcagcaatacattaataattttcacagactctcacactccataactaagctttttgcttgatttttaaagtgattctaattgattcatgtttctgaattgcttaagaattatttgagtattgttaatttgttgttttaagcagaaatggtttctttttcgtattaacagaacttaaacatttctcaaacaaatattaaataagaaaaaaatacaattcaggaagtgataggaaggctgcttctatttaagctgctattcagctgcataatactgtataataatgaggtgatgccaatgaaacagaaaacgaagccatcaccggcactgcttcaaacggttcgtcatactaattccgacctgacagaacgctttgcgccaaacgtcaaccggtcgctgaaagtaaccggtgcccttggagccgctaatatttttgtcggattgggaaagctctccatgggcattgtgtccatgtcgttttttacatgtgtaaacgcactatacacctttggaatggtgattgccaaatattttgcacttgcaggtattgtaaaagccaaagatctgaaggaacaataccgttattatatgctttccggaatgatcttaacgttttccagccttttgtacatcgggtattccattcggttgtttttttaccctgcaaccagtgtctatcacatgtatgcagctattgctattgccacctttacctttgcggagcttaccatcaatattcgcggagtgattattgaacgccataaccatacgctgctggttcacgcgattaaaatgattaacctggcgtcatcccttatctgccttgtactcacgcaaacagcgatcctctcttttgcggatacccaggtgcatcttcatccggctgctaatggtctgattggaattttgatgggaagctgtgctgccatgcttggtataatcatgattatccgcatacaaaggattcgaagcggcaaaaactacggagcagcttaccgggaagtcaaaaagcttatgaagaaagagacgctgcatattcccatgaaaccaacgggatattcagaaagtatatctggcgagccggtattatatgtaaagcttaaaacggacagttcaaaagcagaattcataagtctgcagaacctggtaacgatacagctgaaaatgcatcttattgatgcaggaaataaaaaaatcagcaggaggagtgaaaaatgatcaacatattagtggtggaagacgatgttaagctcaatcaaatcgtatgcacttatttaaatgacagcggctacaaagccaagggctgcttaaatccccgggaagcatatgatctcatgtacagcaacttatacgacatgattatttctgatattatgatgcctgaaatcgatggatttgaatttgcggaaacggtgcgtcagctaaataaaaccattccgattctgtttatgaccgccaaggatgatattgtttccaaacagaaaggttttaagctgggcattgacgattacatggtcaagcccattaacatggatgaactcatcatgcgggttggagctttactgcggcgcgccaacattatggaggatcggaaactggtggttggcaacctttcaatggatgccgatgctgttactgcagcggttgacggtgaagacatcccgcttacactgcgggaattcaatattctttacaagcttctttcctatcccaaaaagacgtttacccgtgcccaactcatggatgagttctggggagtggaaagtgaaaccagcctccgtgccgtagatgtttatgtcaccaagcttcgcgacaagctttccgcatgcgatggatttcaaattgtaaccgtcagagggcttggctataaggcggtgcttgtatgagcagaaaacaaaaattttccgatccaagggtaaagtcaaaattgtttcctgcttccggtttcgtgctgacttttttggctcttgcaggtctgactacgggacagatgctgattcttcaagattatttagattatgaaagactatccatgggatatgtgattgcggtcttaatctactggacatttgttgctgcggcttttgccgtatttacacaatatcagtttcaggaacgctatcaaaaacctatggcggagtttgccaaagccacccgcaaggtggctgaaggcgatttttctgtttatatcccgtccaggcacctgccggataaaagggaccacttagatgttatcattgcggattttaatataatggtggaggaacttggcagcattgaaacgctgaaaacagattttttctccaatgtatcccacgaaattaaaacgccgctgtccattattcagaactatgcacaggcgttaaaaaatgaaaagttgactgatgcgcaaaaagaaggctacattgataccattctggagtcttccatcagactgaataatttaattaccaatctcctgaaactgaataagctggaaaaacaaaatttgcagccggttccggagccatatgatctgtgcgggcagctttgcgaatgtgcactgcggtttgaggatttatggacccaaaaagacattgagtttgtggctgatattgaggacagggcaaccattgaagcagacgccagcctgctggaactggtgtggaacaatctgctttccaatgctattaaattcactgaaccaggcggcacggtgacattacggcaaagctccacacataatgaagttattgtatctgtgtcggatacgggccgcggaatgagcgaagaaacgctcaaacatatttttgataaattctatcagggtgattcctctcattccacagaaggaaatggactggggcttgctcttgtactgcgcatcctgcagctgatgggcggaacgatcaatgctgccagcgtaccgggtcagggaagcacttttaccgttagaattcctgttgaacacaaagcaaagtatacggattaatgttttgcaaacatgttacaagcaatttatcaacactgcttcggtaggattaagacatacaagccccctaacccacctcaggcacaaggagtcgatattatgggtgaaattacaaagaacggcaatgactttgtcggctatgaatataaagagatcactgccgaccgggaacgtgcctccatgtatttggatggttatatgaattttggctggattgccgatgaaaatatccagccttccgtgattttgggaaaagtgacaattaagctgaaacgtgaccgaaagatactgaacaaaacggaactgacccggttgcagcgtcattttgaatcctgtatgaatgagattgatgccatggaaaaatcaaagacctcagatgcaaccatatgggccctggtaattgccctcattggaacagcatttatggccggttcagtttttgcggttacaagccagccgccccacattttattgtgcattgtattggccattcccgcatttaccggctggatccttcccaattttgtttacaagggaaaggtaaggaaaaagattgccagagttactccgcagattgaacagaaatatgatgagatttatgagatctgtgaaaggggaaacaaactgctcaaaggctgacgaaacaccgccacctaccatagggtgacggtgttttctgtaactacataaatttaaaaaatcagattaataaaactcaaacattacttaagcaaaacagaaacagaagccttatatgataaagccatcaaataaatcaataaagacaaaaaggagctgttcatatgagcgaatacaatactaccaatcaagagaagtccaaggccaatagcatccgtaaccagtatctcagcagggaagaaaacaaaatggagaagcttaaggagctagacagcaaagtcaaaaggccgggaaaaattacggcaggtatcctgggtataggcggcgccctgctgctgggtgccggaatgtcaaacattttggtgtggaacgccatgcagccaggtctggtaatgggcattcccggcttaattattgcattactgtcatatcccgcctatacattgattaccaatggcagaaagaaaaaatatgcggatcagattatgaagctgagtgatgaactgataaaataacttactttcttcataaaagggtagcaaacagtaaccaagatgggataagcagggaattcctgcttagctcatcttgatttctatacaccttgaaagttttccaactgatgagtattcatcagaagtttatccatgtcaaaactcactgaaatatagtgcatttaataatttataaaccaaaataaagtaatttagaaatataaaacagttatgattcagtcatcaaagaaaacaaggcataaacaaaacatggagctatttataaaaagagttttttaatgtgaataaaaagaaaaagggtacaaacaaatgaaaacacttcagatagcagccggaatcaaaataggaaaaatccatgttcagcattcccggaagctctttgaaaataccgtaaaataatctgaaaacatcacagtagaaactcatgtcaatatttgaaaggagaaaaaatcatgaatgaaacttcaaaaaatgaaaataactttatcggctatgaatacaaggaattgactgtcaagcgcagtatggaatctgtctatctggacagctaccgcagctttggttgggaactggaaagtacccatgtgccgccgcagggatctacctattccctgttaaagttcaaacgcaaccgcaggctccgcaataaagcggaaatatcaagacttcagcgccagtttgatgccggtgtcgctgaaatccagtcactggaattttctaaggttgcgagagctgcaactgttgcatatgctgtcggactggttggtaccgcttttatggcaggctctgtatttgctgtaacggcaggaaatatccctttgtgcattattctggctattcccgccttcataggctgggtagccccttatctgctctttcgcaggatcagcagccttaagtctgcagaagttactcctctcattgataagaaatacgatgagatttatgaagtctgcgaaaaagctggaaacctgctgaatgattgaattattttaacaggtgccattttaaaatgtatataaaaaatgaaaggaaggagttgaaactcatggcaggtcccgtagtagtcgttggagtggttgttgctgcaattgtagctattgctgcagttttgaagaacagaaaaaaataagctcaggcatggtgatttctatattgcaccagattaaatgctcaaatctccggcaaaattttatatcggtttgaattgggcggaatatattgacatcaaaagcgagtacgaaaacttgatcaaggtgattcgtttcattgcatcggatcaggagaatacaaagaacatttttctattcagcccatgttgcaatcttcattaaaaatactatctaatataagctaaaaagtattgcatacaaaaaacatataatctttgtgaaggattaaacaatattttcttaggaggatttcatatgaacaaatttatggaaacacaaaaaaacatcgaaaacaaggtagtgaatggttacaagaaaattgaagacggggtagtctccgggtataaaaagattgaagataagtttgtggaaactttcttatcagacgaggaggacaactccggggattcaaaggaaaagtgaataaaatgtaaagatattatttataaagaaaatcggtgccgggacttgcgtcctgacaccggtttgtctgctttccgagagaagtaaactgtatctcccttttacaaaggtttttcattcatctttttattcttcaaccgtcacatcagccgtttttccaattttcacttcatcctccggctctttttcctggctgtcagaagatttctccttggtttctgcagtttcttcctgaatttcttcttccttactatctgcagcttcctttccgttttcctcttccttggtttctaccgtttcgtccttagcttcttctgttttgccagcctcggtttctaccgtttcgtccttgccctcttctgtcttgccttcctcaacttccaccgtttcgtccttgccctcttctgtcttgtctaccacagtttctacggtttcttcctcagcttcttctgtcttatcttcctcagcttcttctgtcttatcttcctcagtttctacggtttcttccttagcttcttctgttttgccttcctcagtttctacagcctcttcctcaaccttaacagctgcagaagcactctttccttccatacctgcctcagggtcaaataactcgaccataaacgttaatgtcccgtagccgtctacctcaataatcacttcattttcttcttccgtaaagccatcttctgtaaagtcaagatacttcaccactccataggcttcatccttagatactttatattcatttggtctggaagtagataacatggaagtcttcttataaggaattccgttgaccgtgactgctttatctgcgttcagatactcttttgtttcctgctcatctgttacatcaaaggtcacacgataatatgccggatcccagaaagatgctttcacgtattttgtcgctgccacatcaggtgctggcttttcattttcaaccggattcccggcagcttccagaatttcaaaggtcagtgtcttggctgtgtatccttctgcagtcaccaaaacggtatacatgcctgccttctgaaacagatttttctgaagagcaaaggaataatctcccttttcataattgtcctggctgaacattccgccctgttcactggaaagcactttccttatattgtcatccgggtcggtcagggtcacccctgtgaagttcttcataaagtccccgcgaagctctttctggctttcatcatcttcatcggctgcagcattgatgtaaaccatctgccccacatggtaggctgtcgcttcttctgaatctgttttatcaggattctcagccagtgaaagattaaactgttctaattccttaaccacattcagaataaccgtctgctccttatatccctctgccacaatgcggagcttgtgttctccttccgtaagttgaagggtgccgccgcctgttccttctatttttgacaggatcgtaacactttcctttgtctcgctggtcttataagctgtgatgtattcatcacttctgagagcgattgcagaaccgtccagataaagcgctgttattttggaaatatactccccatccttatcagaagacagtaccagatcctcgcccagctttccttccattcccttaagggccggcgctgactttcctaccacagaaagaaagctttcaaccgttcctaactttccgtcttccagaacccgcttaatctgatacggacggtttccggtctctcctccggtctgggtttccttatatttttcaaaggaaagatattctcctgcctccagttttgcatctttcaccgcatttaaataatgggtgaaatcataaattatttcagcattttcatccataacagcttgtgctttctgatcataccaccactgcacaaccgcctcgctgtactcactcacatagttgatctcatgtaaaatcaatgcgtttgccagcatatcatggtcaaatatcaggaaaccgttcatttgtgagccgccggaagaaccagaaccgccggaaccgccatctcccggtatgacaacagaagcgctggacatggcatcaatgccgaaagattctgccatagcatagattgtaaagccctctgccacaatctgggaactgctgttgacttccactttctttgtcatggtctggtagccatttgcatatgccgtaaccgtatatataccgctttcatcagtgatcacattgccatccggatccgtgccgcaaatatgaagcatggggccgatctcataccattggtctatctttgtgagggacttcacttttcctgacggcatagtcagatccactctgtaaatgggggacagtatttctgttccaaaggtttctccatccggtcctactatatcaaacgcaaagtcttctccctgcttaggactgggatttaaagcatttaaattcattacaaaaagcctgttatccacaagatgaagcggcacgttcatggttgccttgctgtatacggaagacaggttcagctgataacgtccccgggcaaacaggttggtctggggaagctggattgtaattactcctgtctttccatattctgtttccattgaagtggtaaaaacaagattcttgtttaaaacagtgttttcaggatcctgagccttaatggttttcagctggtcaaaccagctttcctgggccagagtctttaacgacatcttaagctggatcttgccgttcccatttttatcaatcaaggtatccggtatgtaataatcggcaggcacctctgaagaagtttcctggctctttccgtttaaccgaaaggtggtcttctcagggcttacacgcacattgccgtctttgtcgtaattatccagccaataatcaaagacagatatggatccgttggtcaggatcgcactgggagcagaaccaaggctgcccatctccggcgcttctgttgcaacgctgtttccaatctttacttcctgtgtttttccgtcagatgccctgatgactgtaatggtaccgggtttccacaaagttgtctgccatttaaccacagtcccgtcatcatctacgtttgtgcaaacctccgtaatatccgtcccatctatctcaatggtataatcgtctatgcttccttcctggaaagcaattactgcatactgtatccagcctaaatcaaccagctttgtcctttgttcatttataaaaacatcctgatcttcctgattgttgccttcttcgctattattaccttcgctattattacctccgttgttattaccttcatccccattggaattgtttccgttatttccattgccggaggaattattttcatttggagtattgctttcacctgaggaacttccactgccagaggaactgcttcctccgctggaagatgccgttttcctggcgttttctgctgcaggcgttgaagctaagcctctgccggcctcgtaatggacagttccgtcagcctccgcccagcggccttctccattgacaaaatagccatccggagttgtctggcctgtgtacatttttcccatgtctgctccatcagcagcattaaaataatagcaatatccgtctatccactgccagcccgtcttcatagctccaagggctccgtcattggctgtatgaaagaagtaccatattccgctgccatcctgataccagccggagcgcatctgcccctctgtgccatcattggaggtgttcagataatatctcattcccttttcatcctgaaaccatcctgtcatcatggctccgtcttccgggctaagataataccagcccgaagccttttgaatccagccggagcttaaagtccctgaagcctcataatgtttccagctttccttttcgtattgccagttgccttgtgtgtatacgcccgcccaggcgataccaatctgcgaaagtacacaagcagctgtcagtattggtgttactgttttttgaatcaactttcttttaatcattccatcctcctgtttttagttagtaataactaaccattgccatctcagtatatcggggaggtaaaatattgtcaatgaagatgtgaaagacggaatgagtctttttctcaacaaattcgttttcacgaattccgcttccagctgcatgtaacagggggatttttttgccagagaataggatctgtttttaaatgaaaaaagaatcactgcctgaaaaaaagttcacttgacattccattttcccaagcgtatagttaaaatccgtacggtactgaccgaaatctctaccgcaaatctactaatcaggtgaatcgaccatgcaatcaaactttttaaagcaaagcacccagcagagacgggatttaattcttaacggctccgtttccgcgaccattttatttctttccgttcccacccttatgatgggtctcatccaatccgctataccggtcatcgacggtttgtttctcaacaatctcgtaggaacccaggcggcaagcgccgtcacttactgcactcccattgtaaatatgatctccgccctggctcagggagtgagtgtggccggaatggccattatcgggcagtccaatggaaacggagactttaagcacagccggaaaattgccactcaaatcattgtttttacttttttgctgggctttctcctggcgccgctgctgattgcccttgcatttcccatatcagcccatgtaaatgaggagatttcccacgatgtctttgtctatctggcgttgagcgcctgtgtgacacccttttctttcatggaatccatctataattccataaagaatgccaatggcaagccggaggacacgtttgtccgaatggtgatcatgctgattttaaaaatcattttcagcgccctctttatagtggttttccgatggggccttgtgggttctgtcatggcttccctggcatccaactttataattaccggatggatgtattatgaattattcttaaaagaaacgggcgaacgatttgttctgtccggcttccggtttgactgcaatatcatcaacacccttttgcgcataggttttccggccatgctttccagcctgatgctgaacctgggcttcttcctcatcaacaatgaagtggaaaaatacggagccgttgtattaaacgggcagggaattgccaataacattacttccatctgctttatactgccctcttcctttggttccgccgtgaccaccatggtcagtatgaatgtgggagcaaaccagccggaaaaggccaaaaaagcctgtttggcgggctgcgtcataagtgccgttactgccgctcttttgatcgcactggtggtgcctctgtcttcaaagcttaccgtgctgtttaccagggatgcctctgttcttgctgtggcaaatcaagcgcttcatatttatacctattccgtgatcggctttggtatctgtatggtccagcaaggagcctttatcggactgggaaagacccggatcaccctctttatcagcctgctgcgggtatggctcctgcggtacatatttatactggcaacagagcactttctaagcttttattccgtgttctggggcaacctgttttccaattatatggcagccattattacaaccctcctgatcctaagggtgaaatgggtttccgatataaattaccgttaaaatagaggcccggacttatcccattgccagccccggccacaagtcctgaatgacctggtccatgaaccttataaaagcagaaaaagagtaccatgtactccctttctgcttttatttatccaaagactgttctagtttttcctttcatccttccacacataaaggattcccttctcctgaaactccttaatctcctcttttctgtaccccagatcttccaggatttccggtccctgctctccaatgagaggaccgcccttgtaatccggaacgcccatttcctggaacttgaccggcggccttaccagtgtgcgcacatttccattgttgtactgcattttatagaagcagtcattggcccatgcctgctcatcctctaaaatctcctcccaggactgggcaacgctgaatgcaatgtcatgttcctttaaaaccggaatccattcctttgccgttttcttttccattgcttccatacagatgtcataaacttccgtccccagcccctttgcctgaaggttctggattgggaaataattttcatcctcaatcagatcatctcttcccagagctttcatgaactgcttatagtaggtgttataatccggcatacaggtctgaatgaatctgtcatcctttgttctccatgctgcgttaaaggggttggcgctctccctgatgttaatgggatattctctggccgggccgtcataattggctgcctggatcatcattcccatgttatagacagctgtctcaaacagactggtctctactttctctccctgtccggtttcttttgcatggtacaatgccgcaagaattcctgccgcaagattcatggccacgttatgatcccccactcccggaaccacattcatgggaaccgttcctctctggcgcagggaatggagatagcctcctcttgcaaaaaatgcagtgaaatcaaaccccggaaggtctttatccgggccatattctccatatcctgttaccatggcataaaccagcctgggatactttacctttaatgtttcatagtccagtccagcccgttccaaggcctggactctccagttggtgatcagcacatccgcaccttccaaaagcttaaaaaatgcctctttgccctccggtgccttcatattaagagaaatgcaccgcttgtttccattttctaagtcccaggtcgtattttcatacatgtccaaaggccttccttccgacggagccgtatgccttaacggatctcccttggcagattcgattttaatcacatctgctccgcagtctgcaagaaaacgtcctgcgcctgccgccgcgataaaggttgccagttccactactttgattccttccaacagcttctttcccatattaattccctcctctatttgtccagttcttctattagtgcagggatcacctgataaagatctcccacgatgccgtaatccgccacctcaaaaatcggagctgccgggtttttgttgattgcaatgatctgctccgaattctgcatacctgccacatgctgaatggctccggaaataccgcaggcaaaatacagcttgggacgcaccgttgtcccggtctgccctacctgatgagaatggtcgatccagcccgcatcaactgcagcacggctggctgccaccacaccgcccagcttatcagccagcttctttaacagttcaaagccttcggctttgccaaggcccataccgccggatacaataatttccgcatcagttaaggatactgcctctcctacctgctttaccacctcaaggatccgtgtcctgatgtcctcttttccaaagtttactgtaagaggaataacctggcccttccggccctcctgcctttcagctttttccatgactcccggacgtaccgttgacatctggggcctgtggtttggacatacgatggttgccattaaattaccgccaaaggccgggcgggtctgcttgatcttcttatcctgctcatcgatctccagtttcgtacagtcggcggtcagtccggtattgcagcggacggccaggcagggacctaagtcacggccaatgtgggtcgctcccaaaaggacgatttcaggcttataggttttaatggcatcatggatcacagcggtataagcgtcggtgcggtaggactccagttctttatgatccgccagatagactttatccgctccgtattcaaacagttcgtccgctagtccctccacctggtttccgcataaaacagtacataagctgcagccgatctcagctgccagtttccgcccttctcccagaagttctttaaccaccggcatgagcgctccttctctttgttccgcaaatacccatacatcccggtactctgataaatcaaccgtttcctttgtttcttctgtcttttctattgcattaaacggacatttttccacgcatacgccgcagctggtgcaggcggtgccgataacagccagtttattttccattgtaattgcttcaaacgggcagttctttacacagatggaacagcccctgcatttttcttttattacatttacagccatgtgaactttcctccttttcctgggttttaaagataatgcttctctttcagtttttctgtaagcagctcagccatttggcatactgttccggcgagcatctctccttttccctttggagcaggagtaaaggaacggaaaacctgagttggggaagcatttaaaccacagtcttttggatccagtcccacatcctcatgattccatatggtaaccttttttgcatatgcgtccatgatgccgcctatgctcatgtaacggggctcattcagttcttttacggcggtaaggagacagggcatctgaacctccagaatttcatatccgttttccagctgcctttgcacgatcacctttccttcacaaagcttcacatcctgaacataagtcaccaccggaataccaagtctccaggccacctgggggccgacctgagccgtatccccgtcaatggcctgacggcctgcaaaaataatgtcatagtctccgattttctcaatacccgcagcaatggtggtggaggtggcgcaggtatcggctcctccaaagaccctgtcgctgagcagataagcctcatccgcccccattgccaggcactcccttaacatatcatcagcctgaggcgggcccatggtaataacggaaaccgttgttccaggtttttcatcttttattttcaaggcctcttctaaggcattcgcatcatcagggtttaaaatgctgggaactccgtcacggatcaatgtaccctttaccggatcgatctttacttcattggtatccggcacctgtttcacacaaaccaaaattttcatcgttttcattactccttccgtgtagtcattatttcttaagcagttttccggaaatcaccagctgctggatttgtgaggtaccctcgtaaatggtgaacacacggcaatccctgtacatacgctcaatcttataatctttgataaatccgtatccgccatggatctgaagggattttgaagcgatttcattgcagacctcagaagcatagtattttgccatagatgcttccatggttgcaggctgatgggtatccattaagtaagcggtcttataaaccagctgctttgcagcctccagctttgtggccatatctgcaatcataaaggcgattgcctggaaatccccgatccgttttccgaactgcttgcgttcctttgcgtatttgatggcctcgtccaaagccccctgggcaactccgatggactgggcggcaactcccattcggcccgtatccagtgtcttcatggcgttgataaatcccataccttcttcgcccaaaaggttttcggccggaatccttgcgttatccatgatgatatcgctggtggcgcagccgatgacgcccattttatgctccggttttccacaggaaattccaggagtgtttttcatatcaacaataaaggcgctgattccttttgttttctttgtcatatccgtctttgcgtagatcaccgcataatctgataaaggcgccatggtgataaaggtctttcttccatttaatatgtaataatccccttccttaacagcggtggactgcataccccctgcatcagaacctgcccctggttccgtcagggcaaagcagagctttttgctcccgcttatcagtgaaggaaggtattttcgtttctgctcctctgtgccggataataacaaaggacctccggaaagggaattaggggaagatacataaatgcttgcaactccgctgactcttgctatttcctccatcaccagcacgtagcagcgggcgtcaccgccggaaccgccgtattcctttggcgtcttaatgccgaaaaatccggcctttcccattttgtaaaggatttcctccggaaatgtcccgctttcctcaatctcatccaggacttcattggtcagttcattttccgcaaactctctcgccagtttccggacaagctcatgctgttttgtaaaatacatgttgtttcctccttaacctcttttcgctaaccgcttctcgacttcctgccgtaactcatggatcataaccttgccgctgttgctgtaaggaaatgaatcaaatcgataaacatatttgggaaccttataatccgccaggttctgacgaacctgctccctgatcctttcttcggaaaattccgctccaggctccgtaatgatacaggctgcaatttcctcctgaaggacctgggcatccactcctaccaccttcactgccttgatttccggaagctccaggatacagttttcaatttccattggcgctatattttcaccgccccggatgatcatctcttttttccgtccggtcatatgaagattgccgtcttcatccagataaccgcagtctccggtgtgaagccacccctcttgatccagcactgcttccgtttctttttcccggttgtaatagcccttcatgatgtgataacctttggactggatttctccaacagtaccggggccggcaatgcaattccttccttcatcccagatccttaattccgtataagggatctttttgcctgctgaaagagccttccggcagattgggtcccaatatccggtcatggtaatggcaggggaagactcggtctgcccataggaaggctgtaaatgctccatcttcagctcttcacagatattgatgtaatccaaagggtgaatggcggaacccgcaataattccgctctttagagaacttaaatcgtattcttttctcctgttgttttttaccatagccaggaacatgctgggaacgccgtttagaatggtgcaggaatttttttgtatgttttccatgactccaatggacttataatactgattgatataaattgccgccccggcatggacagcggacaatatgcccgctgtgatgccgaagcagtgaaacaggggaacagctaagcacatgcggtcattttcgttccagtgcatggaacgcaccatttcggcagaattgttgaccaggttttcgtggcttaacatcactccctttggaacacctgaggtaccggaggtgaaaagtatgtttgcaatatcttttgaagataagttctgtttcatttcttttaaaagctgctgatcttccttcctgttgtcaagcttttcacaatcaggcagatgctccagggaaacgatcccttttaagaagctgtccggaccatccagccctgcatttgcaataaccggtccgtagtccttatcaccgcatccccttccatagaacagataatctgcatccgcttcttttaaaaccctgttcaattcctgttccttatagcatgtattgaccgggagcacaactgccccggacttcataaaagccagatacgccatgacccattccgggctgttggttccccataacgccacatgtttccctttggaaattccttttcttataaagtcagctgcccaaaaatccgaaatttcatccgcctctttccaggaataatgtttatcctgatagcagattcctgctgcattcggcgtaagaacagctcttttatgaagcagttctccgattgtttctgataaaaggcctgtcatattcattctcctgctaacctctgtcccacggttctgtcagttatttctcaatttttcccatggcttccccgatcatccggatcaggaacggaaccagtaccactgcaatggttatataacccagatatccgtatcctacctttaccagtggaagaagtccgaactgggcgatggcaaaagcgagaatggtacataacaatgcacagatcagggtttttgccgtaggttttccttcgtttcttctttcctcaggcttttcaagtgcaacaaccactctctggaccgctcctgcaatcatgtttaccgccgttgatactgctcccaaaataatgagtatggaaatcatggggttcatgaagccggctccaacgccgcctttgatcagagtgataaccggaaggggatccttggataaatccgggttggttgcaattgccatcagtcccagcgtagaaagcatgatcagtacggagtttacgataaatccataaatcatacttgttccggcttctttttctgttttaaatggctgagcatgctggtacagcaatccgatggaagccagctggaaggaaccataaataaaacagctccagaaagcagggcctgcaggtgcgggattcgctgctaaggtactgatgttttctgtaatattaccccagcttgcgataatattcggtatataaacgatcaaaagacctgcaatgataataacggacaaggtggacgccgcttttcttacaaaatccgttccaaaaatggtcaccgcaaaaataaacaaaccgatgatcagggtacagaccatatatgggagcccggtcagggactgcatggtggaacctccggttgcaaaggcaacagacggagccaggcacagcagtaatatgtatacaatttcataaaggttggaaaaaacaggagcgaattttccgtaaaacttgttgttaaaggttctgtaatcataagcatcatgaatctttgcaaaccggagcccataccactggaataccgcaccgatggcctgagccagaatcggggtgataagcgcccaaataccaaaagcaacgaaatactgaaccagctgtgctccagaggcaaaccctccgccaaactgtgttgtaaaccatacgaatgcaacgcccaccgctaccggcattttacttttatcgatcatatccttctcctcctgttaaagcatatctttgaatgcttctatcatcgttcctgcctgctcataatttaccatctgcctgtcgacttccatctggatgattggaattcctgccctgtcacaggccttttttacgattacataatcaaattcttccgggtcacagaattttgtcagcaaaaccaccacacctctggcatcgtatttctttgccatatctacgatatagcctgctctcttcttttccggatcatacaaaacggagcaatgatccatccgggagaacttatctgcaagtccttccaatggttccaattccagattcacatccgtacggtactgcctggattcatgggcaacatcatcggcggcaatctgcagcccgtgttcatcaaagatcttcaaaagcccatcgctgtcagccaggattcctgttgtgatcaccttaattttgctttccttctcctcaacttgtgacagcgcttctatcagctggctgaccagtgccgtatgatcttccttccgcatgaaataggcacttttaaaaatatctcttctctggactgccgtaatggaaggatgctgttccaaaacctctgccagctttctcattgccccattatgttcattgtaaatttcattggaccgggctaaggaagcttcgctgaatttcacgccggccgctgcctctaaatcatttataacacgctcataggaggctttggtaaactttattcctgattccggcttccggttctggggataggtcatggggataaaagggatgtccttcaccgcgtatttccagttctgtcccagacactttaaagagtcgcagagggatgggatgacaatggctgaaatgcctttgtattctcccttaattcccagctccagaatgctctgcataatggaacagataaacgcagggaaatactttttggattccttcagctcaatatccgctccccatgctcccataggaaccagccccatggagtggatcagctcttcaggagtataaacaggaacacaggccacaaccttttttccctgctccagataagcattcagctgttttttcggtgaacacgcaatttcatgaaaactttctaataattcatttaatgttgccatcagtttttccccctttgttggattccatgatctccgtcagcccctgaacccttgtctcatactgggcttccgagaaattccgcgggtccgcctggtctccgtcaaatgaggtgaccggtatccggcagtcctctccgatctggcggctcatctcatacatgaagccgctccaaagcttacaggaacggttggtatgtaccagaagtccttctgcatgggtcttatttacgatcgcttctctcttatcccgtgcatgctctaagttcatggcatttggcacattgcagtaggcgcggatgagaccgtcaaaatcatcgtaaatgaatccaaaggcatcggcataaatggttgccaccatgttgatccccgggattttaagccggttgccgttgtccttaaatgaggccagcaggcaatccctcaaacatgatccggtacttttcctctgcgcggaaggtactggttccctctttcaccgcctttttgtattcctccagcagggtttcaaaggcctcggctgcctccacggtccctcttgcacagacggccactgccatatgattgagtaagtcaaagccgttaaggggagacggggtatacttggtataggctgtagcctccagccatgccctggaagttctgtttgaggtttccatgacctccttgaatttcttttcgctccattttttccccgtgatctcctccagctgttcaatcgccgccagaaactggctcttaacatattccacctgggcgtccgaaacctcgtaatcaggattaaagggaatgtcaatgagaatcagcggaatatcaagctcttttgcaatgttctcataccatttgatcatgcagttgcagatgttgttgcagcaaagcacgaaatccggcagaggcatgttctgctccggagtttccccaccttcatatgagccaggctgatcctcgcatatgcgcagatgtcgttggaataaccttccgcctctgaaacttcacacagccgctgccccgcgcctcttgccgcaatggctgccgcctgattctcaggataacagactttaatgcccagggtctgaaaaatttcctgagggaaattgctggcacaccagccgattttctctcccctgtcctttgcctcctggacctccttgtagtgttttgccacgatctcattcagcttaaacttggctgaattggggtcaatggtaaactttggttttgtttctccttcacccatgaaaaattcctccttttatgatttatcgtaagcgtaaagcgctgcccctaaagcacccataagctgggccattggcgaatatgtaatttcaagtcccagttcctgctccatggcttttcgtaccccgccattttttgcaacgccgccgctcatacacaccgcttcttttactcccatccgttttgccagggtggccaccctgccggctactgactggcagataccggcaaccagatccggaatctcaactccgtttgccagctgggaaatgacctcagattcggcaaacaccgtacaggtattggaaattttcacaatctgctttgccatggcagcctgcttttccagatcttcgatcctcagctgtaaaattcctgccatgacatccagaaaccgtccggtccccgccgcacatttgtcattcatcagaaattccgtcagccgcccttcatcattcagggaaagtacttttgcatcctgtcctccgatgtcaatgatggtccgcacttccggatgcaggtgatggacccccttgcatgacagcttaactcactcatttctccatcggcattttttaacagctttctgccatagccggtggcataaacagcagtgatctcttcctgtttcagatctccttcggcaagcactgcctcaatcgcccgggccggcccgtcagttcctgtcccggccctgatcagggatgtagccagaatttcctgtccatctttcagaatgactgctttggaggtggtagagcctatgtcaactcctaatgtgaacatggtcgtttcctttcatattgtttattttataacaatctttttcaaaaaaaatatcaatgtatacatgtatacaagtttgcgcatgaaaaaatgtatccttgtatacaagtttatataaaaaataaaaaagtcacaaggtacattttttcatgcatagattatcaaaatttgtctaatttgtcaataacttttttaaaaaacaggaaactgctcagttattatatggaacatggttccggtgacgttttcaccttttctccatataatcgtctaatttgtgacaatctacccccataaaaacaaataatcggctgcttttgatgcagacagtcagaaatccttatgctgcggatttccggccactttttctcagccagccggattaaatgtttatgaaatactgaggatacttttccattgccgtatctctgatttcggatatggtttccagatggtctgccatcgcctgctgggctttggcaaaatcaccgcctttgatttcttcaacgatccttcggtgctcgtcgatcaggcatggcatccgtttgccaagtgccacatcgaaattacgccatcttgaaatgtggagcattaaatcctccagcagttttatcagattataccgttccacgctttctgcaatggcccggtggaatgccgaatccagcttctgaaattctaagtcatacccttccacattccggtaggcttcctgcttttctaaattatcctccagttctcttaccagttttccaatcttctcttcgtccctctgggacaaaagctcgtaaagctcttccttttccacggcagtccttaaaatcaataaatccccgatcagctttaaatcgatcaggcttacataagtgcctctctgggggtataccgtaagaagcccaagctgattcagccttgcaaaggcattgcggatgatggttcttgacaccccgtattcttctgccatctgattttcactgattctggttccaggctctaattccagttttaaaattcgcttcctgatgttgagaaaaacatagtcagctgaaaacggctggctgttacttttcatataattcatatttcgtaccttcaattcatattacttttttttgttatgaatcgattatacccttgaccacagatttctgtcaatttgtttcttatggccggtatggccgccgttcttccatacctgatcatatcttttatgcactcagcccttcggctgaatccggaagcaatattcaccgcgatccggtgcatggtgccggaagtctcgaatcaggggatttctgtacggaaaagaaggtcagattttcgtttttatcaaaagaagcttttatccagcggatgaattctccatccgtcagaaaaaagctcctcagcttgttttataaatcgatctggaaccggtcaggcaacacctttcctattgatcatcgctcataaacctcccagaaaacgatccaatgcccaggccacgccctcctcgtcattggtctttgtgataaagtctgctgtctttttcacagccgcagcggcatttcccatggcaatgcctaatccggcccaggcaagcatttccaagtcattttcgctgtctccaatggccatcacctgctccggtcctattgcaaggcaatggcataaatatttcagcgcctctcctttggacgtccccttccggttaaactccagacacatgtgtcccgttttcaggatgcaaaagcccggaaaacgtctgccccaggccttcacccgcttttccgtctcctcgtcaaaggccataaatccaatcttctggatatcttctcctttattttccaagaatcccggcaaatccttaagcttcccctccctggaaaaacccaccgatgccatataaggatgctttttctccatctcctccgagcggttgccgtcctcataaaactgatcattctgctgaaaataacactggccgttttcagcccgcagacagcgcagcaggtccatgccctcctgaagtttgattctgctttcataaatgtatttcccggttcccgtatcaatgacggaggccccgtttccggatattacatagggcactcccagccttaaaatctcctcaggaatccaattgtaagtccttcctgaagccggaaccaccagaccgcccttttccagccacttcttcagtgcttctatggtttccggcgatacgtttccgtcagacttaagagccgtcccatccatatccacggccaccaggcgaatctttccgccgcaaatcttatctgacatatgcctttatcaaaccaatcctttcatgctcctttaacggcctcacccggtatgggcccacactggccggcacaataaatgtttctgcataatgtacctcatacggctcaaaatctccagacgggctttccacaaccgcagccgttccctccaccagattcagcatgtgaacggtacccatggtatgaagctctgccggccggtctaaccagtaacgccttgtttcgataaattccagttcatgaagccccgtatgttcttcaagatatccttcctcttctttcaccttatagcaggcattcaccagattttcctccacccacttggtggttctgtcccactggatcacattcatcccatggtcaatatggatgggtctgggctttccatccagtcccagacgtccccagtcccatagcttaaaggtgaatatgtaaggcgttgcgctgatttccaataccatgacattatttccggagcaatggcaggtgcccgccggaatcaggaaatggtcgtgcttttttgcaggaaaactgttgatatatttttccgcgtcaaagtcacatatcccttcctgtgccgcctttaaatccttgatcatctcttccttgtcaacgccctcctttaatcccagatagactgccgcgtcttcctttgcgtccaggatgtaatagctctcatcctgtgtatactgcataccgaattgcttttttatatactcggtcagcggatgtacctgcaggcttaaattctggccgcccatggtatccaggaaatcaaagcgaatgggaaattccgctccgaaccgggcgtaaaccttctctcctaaaagcattctcggctgatacagcaccagatccatggcgggaacctccaccagcaccccgtcaaaattaaacagcagactgttttcctccggtaccccatcaaagctccaggcataattttcctcagaagtctccagtccgaaaacttccttcatccactgtcctccccatactcccgggtcaaaatagggcactgtacggaacggctgccttgcggtttgttccagggcctttaaaaaggcccggccgctaatcatcttaggagctccggccttattggtatccatcagataatccatgcgctcaaacatctgcgccttgtgtttatcagcgatcctccactccacaaaaaagcctcttttatacttctttaagatatcctcatccccgttatccgcccggtaatttcccattcccttccggtaacggagctggatctcccatctggccatatccaaataaaccagtaagtctccctgggcaaccaaagatgctccgaagccatagacgatcgtaaagcctttcgcctctgccacttctttcctggcctctgacaatttttccatgtccatgaaatccagaatttcccctgcatacatttttccgaaaacacggtcatcagtcagctggtattttaactgttccctgatcgtcctttcttccttaaagacctctgctgtctgcaccaggcggtctggctttagcagggaaagggcctccagcacttcttcatcatcaactcccggataacagtctacaactaaaacaaagggtgtctttctgatctttgattttaattcctctataatttccccatatccgtcaaacacctcacgctcaaagcccgtgatttttatctccgggtatttctcatattggaatttcctgtctatttgcatatgatttctccattctttttataaactctcaccggaaagggatgggtttctacccaatcatagttatggccggcgcaggatggccagcaggctcccacctttaacacctgatccccggtatttaccaggcggtgggccagattcccccggacataatgcagggaattgggataaaccttttccgcccaggcatttccgtctaaatccattaaaagcagaagcccttctcctgcaaggccaaaataatattctccgcaggaagtatcctggtgaatatgccccctggtgaaattacattccccgctgacacactccggatacataaccgtaagcccccagcttaggcttcccggctgaagcttatcgtcctcctcataacaataaacctcatacattacccgctctgtattttcttctttatcttgattctcataagccgtcagaatatcctttaacagcttcctgcttgaagtcaccgtttttccttcaatcactccattgtacaaatcatgcactgcctttggttctatgatcttcatggctgaaactcctcccatatctgtttataatcctgaggtttcgttacaaaagaaaacttatctttattctcctgaaactgggtatagatgggaattccctttctgatcccaaactcaatatattctcttggcgttctctccaccagacgtcccccctggtatgcagagttttttctccataaaatgtccttttcctccacatatgggaaataagcgacacctccatggctccttaccgcctcatattcaaatccgtaatccctgacgcaccacgccccaaagcacatgtttctggacacgtcggcgtttaccgtggcatgaacccagtcaggcggcacgatcaccacatcccccgcttttgcacggaccgcatagcaatttcccgggtcatctcccccgaactcctgcatatagatgatagcctcgccgtcccagatctcataaacttctggcgtggaatatccgcaggaagggctgaccgcgtggatatggccctgggatcgcaccggttccctgccgatgactcctgccgcatagacaaccgctccgtaaagaaggttgcgtttttccatatcttttctgtcttcttcacagcccacgtccatggatatggcgtaaagctcctccggtccgccgcaggacggatccgctaaagatgcccggatgtcatccagccgccggatctccggcacagggccaaacactccctccccatatgtaaatccaatgggccgtgactgtggtataattttaaaacctggataaaaatccattttgttctcccctttcatgtttcattccctgatgcgcattggaatgaaatgcgtatttgggaatttccttaccgtctttaataaaaacaggagtgcaacagtacccactgccgcactccctttccctatgatttgtttatttgccggcttacctcttgatctcaacggagtaagaatagcggtcccccctgtacaggctgacggtatactccaccacctcgtcattcctgtcataagaggtccggatcctcagcaggaccggtatggtctttttcatctccagcagcttctgggtatgactgtccggcatgatgcagctgaacttttccacgatcttgaccggcctgatatccttctcctccagcatggcgtacaaacttccgtaatacagctcatcgtccatgggaagctgcctgttcatgtgaaaataagactggaaaatgacgatcggctttccatcccctgttctcaccctctccagacggtataatggggcctccggctggatgtgaaacacgccggccagcttggcatctgctttgatcacctcaatatgagcgtagctggttccaggttcaatgcccttttccttcatctcgtccgtgaagctgtaaattctggtgaggaactcttctatcgtcttctgatagatgacaaccgttccctttcccctggcacgccttaccagtccttccttctccagctcctggatcgcctgcctggccgtgatacggcttacctgatacatgctctgcagctccgtttcgcttgggatgatgctgtcaaactcatactctttcttcaaaatcttactgcgcaggatgtcactgatctgtatatataagggtggtgcgcttttcgaagtatttaatttctccattcctgtcatctgcctttccgcgcctgcttctaaagtgctttttatgcggatctcacttattaatacgctataacattataataaataataccctctcacttgtcaacgttcacttggcagactgtcataagtttgccgtgtttagaaaaatccgacggccactcctacaaaggaaacaacgaccagcacacccataaccttaagtgcggacattttctttttcgacatcagccaccagcataagagaatcaccaccaaaggcagtaatttagggaaaataccgtttaatacgtcatttaccactaccgttgattccgagtttccggtctggatgttcataattgaattaatgcttacataggatgcccctacacctccgaccacaatggcgcctaacaggttaaaagcctcacggattctctgggaagcttctcccacaattaagttcaccgatttggttcccatctggtagcccttcatgaagagataatagcttgccgctgttacggaagtcataaaggtcactatgtagaaaaccgggccaagagcgtttcctccctgggaaaggccgatagcaatggataacagcaggggtacgaacatgcctggtaccatggcatccccaatgcctgccaaaggtcccattagccccagcttaatgctgttgatcacttcatcatcaatatccgctccgttagccctctcctcctccagaccgcaggcaatgccgttgacaacgctgccgatctgaggctccgtgttataaaatgcacaatgacgttttaaagctgctttctcctcttccttgtcaccgccgtacagctccttgataaccggcgccatggaatcggcaaaggcgaaagactccagccattgaaaggacatggaagacaaattgccgcacagccaccgaaaccaacttttccttaatgtgctcttgctgatttttttcatattacagttcctcctccatatcgtctgctgccgcagaaaccttgactgcattgtctttttgggtatacaggaaatagctgtacgcgaagaacgcgccaaagatggcaatggtaatcatattgatgcccagagctgcaaccaaggcaaatccaaacaagaatctgacaatctcgatatttttcttggtaacctgttttaaaagaatggcgactcccactgccggaagcatgccgccgatagcggtcagtgctctcataacaaaggaatccaccgggaacacggcgatgatctccgatgccagcccctggccgaaatacaggatagccactgtgggaatgacacggtagcagaactgcagcacctggggtcctacccagtgattaaaggacagtcctttgtaatcccctttttccgcacatttcatggctctggcattccagaaggaattcgtcatcatcataaaattatggaagatggttccgattgctcccactgctgttgcaatggccactgccgactccacggttgcattggatttcactgccatgattcccaatcctacgccgatgtatgccgccgcatttaaatcctgaggcatctgcccgcctggtgtaaccagggctatatataccacctgaacggcgataccaacgatgataccggtctgaacatcccccatgatcagtccaatcaaaaaaccggaaatcaaaggtctggaaagggtgtaccacccgccggtgagtcccagtgcccaagggcaggacaaggagcccagatacgataaaataccgatcataactgcctgtatgatgtttatctgcataataatatccccctaatattcaaatagttaaagtagtttttgcctgacatcgctccaccgcacctttgtaaaatcaggaaccagctggaactctatctgatagcctgcctgatgaatccgctcatagctggccatatcttccttggtgatatccgcgttcttattgacccggatggtatcctgctttgcactttgcggccctacatttaatatgccagtgtttacctttaagccgtaatccaccagcagttccgccatggtatcaggcgttttggtgataacaaaataatttttgctgctggccaccgcctcatccatcttagaccggaacttttcacggctccatataaaagttttctttgtggatgccgccagcagggcatttttaatcacttcattggatgccgccttatcatccaccgtaatgatcccgtcgcagggatattccgtggaccagcggataataatctgtccatgaatgattctgtcgtcaattcttataaaactgattgccaccctcaatacctcctttttattttccctcaaacctatatgaggagaactttctgctatagttcctcatcgtcatcttcctgccccatctcaaacagatgcagacttccctgtgcttcttctgcacagtgcttcaacatttcccggctattgtccgccgatgcaagaaccagcaagagaagcggtaaattcattcctgaaataacattggccctgttcaggccccccatccctgccaggagctccagtgtggtattatagggggaaccgccgctgatgtcacaaagaaccgtcaccggcgcctcccaattcaccctctcaaacagcctctccaattctccccgaaatgtctcaatatctttctcctctgtcaggcaaagataagaaacgtccggcagattaccaaaaaccattttcgcggcatggtacatcccctccgccatggtgccatggctgagcaaaacaatctgtttaatggttttttcctcccttcctgttcattatagaacattatattgttgtaacaatataatattataaacttatgcaaatgtcaagatttttttcatttaaggagttacttctgtgatttaattatgccctcatatccttcccataaatccgttggttttataaatggttatcctgtgatggcatcatcgcttttgtatcaggatgtttccggaccggaaaagaggatttaagcttacacgcagaaaatagaaagagcttttgcctgacgggcaaaggtaacacccacctggcaaaagctctttctatcctttctgaattttcacttattcttcctgattcgtattattttcagagggggcttccgccggtctgtccggccttgctcccctgctttctccttccggcttaaaatcgccttccggcagctctccgggcctcccctgtcttccaccggctccatttcctcctctgattccgcctctgtcctgttccaaagcttctcctgactgattcacaattccggtcacctgaatttccgttgtatcttctcctgtacggatctgataggttttccctgttttcagatcaggagagctgaaaatcaacacggaaaattccttatcaggagtaaccgtggcaagctgtgttcctgaatcgtctaaaacctccacagctgttcctgctgcctgtttttcttcgtaatattttaccataaccggctggctggacgtttcggaaaacacctggaacatcccggcattgccgactcccgtaaaggttccgcctgtaatcgttcctgtgccgttaaaatccagaattccatttccgctgctttccggcccttccacgtaaatggagccgccttctataaaaagatctccgtttgaatcaattccgtctcccatggcctttacgcttaagttgccgccggtgatccggatgtaagctccctctgtggatgcaaaaggatcgtctcccatctttccggcattcccggaagagtcattgccgcctgcagcattcagcccatcatcatcagataccaccttaatttcccctccggttatgtcaatacataaaccttccaggccttcatagcttttggtgatatcaatggttccgcctgatatctccacctggttatctccatgaatggcatcgtctcctgttgataaagccagtgttcctgatgatattttcacatctttgttgctgtggaccgcatcatccactgattccacggctatgtcccctcctgctatttccaccagagtctctgccttaatgcctttttctcctgcattgacggtaaaattgccgccgctgattttcacatatccttttccctcatccgtatcattgctggcctggattccatcgccccctgaggttatggcaaaggtcccgtcagctatttccacagaatcctttcccttgatcccgtcattcaccgaattgatcacataattgccggactgaatggtaagatcgtcttttcctctgatgccttcctgataatttccgttaacagtcaaggttcctccgccttccaagacaaggtcatccttactgaatatggccgcattaggttcatcttctcctgctgtggaataggagtaggaggaaccgtctgatacggtgttttctgttccatcttccaggacaaccgttaaaaggccgcactgctttccatatatggggagaaatccgaacttgcaatggaaaaaccgtccagaatcactgtgacttcatcctcggttcctgcatcgatcaccacccttccgtcttccacagtgccgttaaaccggtaggttcccgggtcagaaatggtgaccacgttttcagaagcctttgctccgcttcctgctacggtaaatccctgttttgacccggtaatgacggtttctgtcccactgccatcactttcattttggttaaccgtattcccgctgtccttctgacagcctgtaaggaatgccaatccaatcaatcctgctgcaaacagcgcgccccggttcaccgggtgtccacatcttattattttattcatttatgttcctcctgaattttctataattcttctctgccctccggaacccttccgcatgtgatgggcagattgccgtttctgcatcggatctcgtccagcatttttttctcttcctgctccgcctttaaatccacctgaaaacaaagctcgtataggcttcccatatttacggtcttgactctgttcagatgtacccttccggcgtactttgaaaatatgtcgtcaaaaatccccgtataatcaagattttccggtattgtgatcttaagctcccgctttgtaaagcctttccttccaaggggaagagataccaggagtatcatggcacctcctattactgctgacattatggcggccgctcccaaatatcccattcctgctgcaagccccactgccattgctaaaaatatactgcctatctccctggaatttcccggcacagagcggaaccggaccaggctgaaggcccccatcacagctactcctgttcccagatttccattaacaatcataattaccacctgcacaatggccggaagcagtgccagtgttacaataaaatttttactgtatgtattcctgaatgtgtgcagaagcgccaggaaaacgcccagtcccagagataccaccatgcagatcatcagatgtcccattgtcagccccccattggttgtttctgttaaaatactttcaagcacaagaaatccctccttccggagtcagcccaagggtcccgctgtgaccaagaaagccagaacctgaaggcacatcctggtttttatataaaatcagcttatagtacataccgtatttggaaaaggataccggaaaaataccaagccgggaaaaaatgctgctcatccatacaggcattgccccagggattttaacctccataagaacctggttttcatttaaaatacatgttccataatccccttttatcagatccagttctccgttcctgcaccggatattccggtcaaaggtgactctcagctcgctgttttcatttccaaaatacgcagtcctgtcataggctacaaatgccatgggctttaagttataaagccccataacgtaatcgatctccttaagaatctggctgtccttttccggatatatgccataataaagatattttctggcctctgtcatggtcagcgccatcctgcgcttgtagacgatcccatcgtatttcttttttaattccgcataaaccgtactttcttcctctgcccttccgtatgccctaagacggaccttttccttgtaatttggcttttcagccgaccggcggatgagttcaaaatctctggtatcaaaataaatattggatattgtatgtattccatagctgtcagcggtcatatactcagccagttcccgcatcaatccctggtattgggcaagagtcaagaggtatttcttttcatatcttttaaaaacttcctgtgccatattgacttcctccttttcttttctatgtgctatatcctaacatccccaactgaaaggaaccttaaaaaaagtgcttaaaaccgtgatatttctgtgaattcttctttataaaagaacattatcgggttactgcgggaaaagattacctttcagatgaacgtttctgtgttatactgtaaatacttatactaactaatgaatgtgatggggagccatggcaatggaactgaatacgattgtggagcattttgcggccacgctttttcaaatacggggtgtttaccgttataagataccttccggaagtaaaggaatacaaaaagccgctccttatcctgggtttatattccctctttccggctgcgccgaataccagttcaacaacacgccttatttaatcagaccgggagtcgttttgcatggttcggcaaacgccgttatgcgtaaacgggtcgtcggagaagaggactgggaattcgtttccattctttatgaaacctttaatgaaccacctccaataaagatggcaaatacacatttcagcctgacggtggggcaaagtccgcagctatatgacatgcttcatcagctgtacactgcctcagaccgtcccggcgggcttccggcctttcaacgggagaccttattccgccgcatactggaagaaacgtttttgtgtgtcagaaaccaaaccaggtacggggcccaggaggtttttgaatccgtgtcagagtatatccacacacactatatggacgccttaaccgtaaattcacttgcaagacaaagcggagtcaatgaaaaccggttattttacgttttccagaaatacgcaggtatggggccggcagattacttgcgcacataccgcttaaaccgtgcaagagatctgcttgttacaacttccattcccataggtacaatcggggagcagacaggttacccggatgccctgtatttcagccgcatatttaagaaacattttggagttcctccaagtaagttcagagaagaataagcctctttcccaaagaaagcgccggcgtttgtgcaccggcgctttttcatgcttctatttaaaattcaggatatgtccatataaattatggataaagccattcacaccagcacctgactttgatatagttaaccggaagttagttctgtctaaccaataattcaggaggtgttacattgaaaaaacatagttctcttttactggcactcattttatctgccgggcttttatctgcttgttcaaacggatcacagccgcaaaaatcttccgcaccggggcagtctgaaagcaccggcgcgccgaattcttccgtatcccaggctcccggcatttcacaggaaacctcttggccccgcaccatcaccgatgccggcggtcatgaaatcaccctggctttagaaccccggcgcattgccattctccactccaactacttagaatatttctttgctctcggcaccccggtcaccgcttcggcaggcgcttccgttggaacagcccagcaggcgctggaaacatatgaaacactgatcccctatgatgaaactgcagaaatcatggaccttggaagcgcacgggaaaactggaagcttcatcagtctggctgaacatggatgccgtgaaaaacggcaatgtggtttattttgatgattcccttaacacctttggccccctggccatgggcctgactgccgaaaagctggtgaatacaatcaaatgataaccggtcgtcacgaagctttctcattgcggtccgggacggaagcattgttgcaaaaacagcctccgatccccgtaccggcaggcctgcctgcatctcataccatttaatttgacaagggagttaatattatgaaacgaattgcaatttatggcaaaggcgggatcggaaagtccactacggtttccaacatctctgccgccatggcaaaaatgggacttaccgtactgcagatcggctgtgatcccaaggccgattccacccggaatttaacgggcgggaaaaacatccccaccgtgctggacaccttgcgggacaagggggatgcagagcttgacgatattgtgtttaaaagcggtaccggagttttatgtgtggaatccggcgggccggttcccggggtgggctgcgccggccggggtattatcacagcatttgaaaagctggaagagctggatgcctatggcgtgttttcccctgatgtggtgctgtacgacgtattgggtgatgttgtgtgcggaggatttgccatgcccatccggggcggctatgcagatgaggtgtgcattgttacctcaggagaaatgatgagcctttacgctgccgccaatatcgcgcatgcggtcaagagctttgcccccagaggctatgccggcctgcgcggcttgattttcaacgcaaaaaactttgagggcgaggaagagcttgtgcagaaggccgctgatgaaatagacgcctccatcctttttcacatcccccgggacccttatgtgcagcttgcagaagatcagggaaaaacagtggttgaagccttcccggaaagccttatggcggagaattacaggaagctggcccgtcttctgctggaaggaggacagtcatgaacgacatcaaacatttaaaatgcctttcagctgtcaggagcatgacggctgtccggcagctcacacccgccgcctttcccggcgtacactgccccatgcacacggcattgtccctggccgtaaaaataagaggcgtgtccacgctgattatcggcacctctgaatgcgggtactacagccgcagcgtgcccctttcctctccttacggagatgaggctttccattggaattacgtcctggacagcaaggaagtggtgtttggattccgcaaagggctgatgaaagccatcgcggagatggataaagcaggcgcaaggctcattttgctccttgccacctgtgtgccggaactgatcggagaggacatagaaagcatctgccatgagatgcagcaggaggtaaatgcaaaactcatccatctgcctcttggaaacttcaaatgcggcggctatgaacccggatattggaaaacccttctggcaatgggaaaaaccatggaaaaggctgtcaacaagggaaccaccgtcaatgtacttggccgcagcagactggaagaacacgttcccatgccccatctgattgaatttctggaacacaggggcgttctcttgcgctttttggcgccggattcctcactggatgactttattgctgccggggacgcaaggctgaatctcgtcctttccccgtttatgaaccctctggcccagtggatggcaaaagaacatgatacaccctttgtcagccttcatgatgtttacagtgtccgggaaattgatgagacttattcacagatcggatggcatttgggattagagatccaacagcaatttacaggacagatgacggaagcgaaaatagcagagaaaactgcaaaagccagtttaaaaaacctgcaatatatcagcgcaaacataggaactgtacagcccctgcccttatccgcatacttatgggagcttggaatgtctcccatcatgatacacatggcggaattttatccctctgacacagagtggaaagcaaaactcaccgggcaggaggtaaaccccatcatctgccttatgctcaacgaacaggctgacatgcagatcatccaggccttgtgccctgacatggtgatcggtgactggggcggcaggcagcagaagcagccgcccagtgttcctatgctggatttgtacggtcatgtgggatatgaaagaaccactgccatggtggaacgcatcataagagccgccgggaaaggaaaggagggatctgcaaatgggactgcataaaactgcaccgcccctttccgggcggatgggcgcactttggtgcttatccgggatcgcccagtcagctgtgctggaatttggctgcatgggacatatggcctacgggagaacctttcttcaccggatgggtcatttggcggaaagctctattcaacccacatcggagaaaccgatattgctatgggggacaccggccgcttatcaggtgcggtggaatggctgtcagaaacccaggacataaagaccatcttcctgctgccctcctccgtgcccgaggtgatcggaacagatttaaaagccattgcccaggagctgtccccccaatttcctgacacacgtctgattccgctgactgcaggggatttgatatgagcggccacaagggggtggagctgactcttttggagctatgcagaacatttccaaaggaaatgccaaagacagaacagccttcctttcacatcatcggttcctgcgcagacatgttccgttttcacgccgatgcagcagaagcagcacggctggtgtcaggtgccctgggaatgaaacatttgagtaccatgacctcaggcacaagcatctcccagctggaaacactgggagcagctcatttgaacatcgttctccggcgggaaggagaagccgcagcaaaatatcttaaagaacgttttggtacgccttatctgacggcacgcccttacggaatacaaggaactcttgactggctggaacatgcagcggccctgtgcggcaggcaggctgataaggcgtttattatccaggaaaaagaacatgcactggaacaaatcgctccaatgcagtctgtgctgtcccgttttctccgcgtccacaaggaggaaaacaggctgatccttgccggacatgccgatgcagttcccggaattgcagaatacggaaaagagtgttttggttttacacaggccgattgttactgcgattgtccagaaatggcagatggggatatggcttatctggatgacgatgccaaggaacgcattaaaaacgatccaaagggctttcttatgggcagcggggaactgcttcgtatggcaaacagagaccagagcctgcaaatcgcaacgcctgaccacgtctggcgccatgcttatgaacctccgcttgtgggatttcggggagcagtaaacctggcggcagtgtggaccaatgaaatgatgaggctccactgaggcactgtggaaaaaacagtcagaaggacaggcataggaaccgcctgtccttcttggtttttccaatattttatttattctatgattggacccaggcaccgtcgcttcctacatcatatccatccggcgttgtggtgcccgtaagcattgctccgctttctccgcaataataccatttggaattccatttgacccagcctgtgaccatatacccggtctcgttaaaataataccagtaatcatcaatatactgccagttgctgacagtatagcttctgtccgcattgcaataccaccagcctgtgctgaccttcagccatgcgccggttccctcggtgcttcccggccctgaaacgctgcctgagcttgaggaactgatctcttcagcctcttcagatgtaagataccaggtgtcagaatcttcccagctgcctttattggaggagttatatactccccgtaccttaaagaaataatacccgctctgtgtcatatagcttgaaaaatcgtagctggtataggtggtcgtgagggtggaagttattaaactgcttcctctgtaaagacgcacctcatatttattggcatcctcacattcatcccaggaggccgttccatccgactcatcccattctaagttgttcacagccagattatagtcgccctcctcatcctccagagcatccagtgttatatacacggtcaaggtactgctgctcctgctgacagaactgactgtcccgtctgagccgctgaggcttacgctgcttttggaaaagcctgaggcaaaataataatcatcctctgcgtctaaagtgacctttaatttaggcttgtctccatcctcccattcgtcatccggttcatttgtaattaccacatcattgacactgaatttgctggaactggaagtgaccgtaacatcaccgccgctctctcctgcctcaatctctgatgatatgtaaagggaaacactgctaatctgggtacctgttgccgccagcgccgtcatgggaactgctgacaaaacggctgctgttataaatgcggcagaccttcttaacatatccatattaattcctccttatttcatgttagctcaaatttggtgtcctcttcctaatctaccacgtaaacctgaaacaaaccttaattttccatcgtaaatttgtgatttttttatgaattcgtatatggatatgaagcgttaaagcacttttctttcattatgaggcttctgaaaccattgcctcgcaagctgtctccggctgtaagatcgtgagaaaaaatgctgttaaaaaccctacaaaacagcttacaacaaacaacccaaatccttttccaagaaaaacaggcagcgtaatcagacttggaaatgcaaaggtcatggcctgggcacctgaaaatcccgctacagcccctcctgccccgccgccgatacataccgcgatcataggctttttgcgcggcaggttcacgccgaacatggccggttccgtaactccaaaaaaggcagacacaacagcggacagacaaagggaccggaactttttatccctgcttctcaaacacaccgcaagtgccgcacctgcctgggcaaaaactgcaggccctattaaggccagtatggtatcagagcctttcacagaaatattgttcattgcaaccagcacaaagctccagtgaaaaccaaaaatgaccattggctggatcaccgctcccagtatggccccggcaatcattgggctgacctggtataccgattcataagccgcagccaggccgtctcctattacatttcctatgggtccgaatacaaataaggtgaccagaccgactaccacaatgcagatcaggggagcaaaaaagctttttatcagttccggcagtattttatataccacccgttccacatatactaaaagccctaccgcaaggagggtggggattactccggaatgatagataacagccttcatgggaattcctgcaaaatatatgttcgtgcccgcttcaaatgcggttgttaaggtaggatataaaagcactcctccaatgaccactgccgtaaatgggtcagtaccaaatttttttgctgcagtaaatgccagtaccataggcaaaaaataaaacaggctgtccgccatggcatttaacaccagataagtctcactggttcctgacacaatatttgccgcggtaaggatggccagtatgccttttaaaattcctgccgcgcttaacaaattgataatgggcagaaaaataccggaaatcccatcgatcacaacattaatcattgactttttttctttcatgtgtaccctctcctatggtgaaacattctcagcgaaagctttcttttgctgcttctgccattgtaacacattttacatcattttccatacgaatttttaccggataaaacgcccattttaatgaggtatgatcccaagatcataaaaaatcttgctggattccggcattgcttccagtccatagacattcatccataaatcctgcctggtttctgcagaggaccggataatttgtgaagaaaagcagcaggggttcttccctgctgctcaattccggagtcccttttggccctatgcctgctcactttcaagcttttctgcagcctttgctgcttccaccagtctttcatctttaacctgatcaatacccaattccttaaatgtggtgggaagtccgatttccctttactaaagttttgtaatatccacgccaccaaatacagattcccagtcttttccaaaatcatcaatagccttgcttatagaagccatgccaaaggcttcatggagaagctccggctgcagggtggctgtctgggcccccgcggcaaaggcggcatttacctgggcaatgttcttaaagcttgccgccaggatctttgtcttataacctccagctgcgatctggtccgcaaagcaggcgatggtatcagctgcgtcgatatccaggttttccattcggttaaagtatggagcaataaaatcagctcccgcctccatggccagatacccctgtatcttggaataaatcgcagttgccgtgatgcctgccccctcagtttttaagacccgcattgcttttaagccttcctctgtggttggaattttaataaatacgttcttatccaccttgtccaaaatagttcttccttcccggatcatggtatccccatcccttccggtcacctggatatgtaaagagcgttccattccgatcaccttgcggatatcacaaaaatgtctgaaaaattcgatcttgccttctttcttaatgatagaaggattgctggtaacacctgtaatgggaaaaatcttgctgtattttttaatgtcttccagattcgcagagtcaaataaaaattccataatcgttatcctctctaacttatgattgtcttttatactgaaccggtaagcccctgcatgcctgttctaaaaaactccccccttttatcctctattattagatcttatataccattgttttgtaacttcagtatacccctctgttttgcatatgtcaatacttccacttcattcgaaataattacatttttatttaaaattcatttgcttttgttcattcacatgatattgtatcgatacaaagggatattcacaaggcctcatgcccctcatgcttcaaactttcaggatgaggagcagtttcaaatgaaagcaaccatattcaaaaattcagcatacacgacggaccgggaatccggatggtggtcttttttaagggctgccccttgtggtgcaaatggtgttccaatccggaactcaggcgccccatacccagatcctctggaaccgtgagaaatgccttcacagcgggctgtgtgaaacggtaaaaaaaaacctgcatctgccctaaaggcaggtgcagggatctcataacccttcctgtttgcgtgcagcagctctgctacacctctatcacttccacggcaatctgataccgttccataatctcttttgcactgtccggaatcccattgtccgtatataccatattgatattctcaaaccgggactgcaaaacgacaccctgctgctcaaatttgctggaatccgtgaggatgatggaatgcttggccgactccgccatgttcttcatggactctgcccgcatcatgtccccgcaggtaaatcccgcctgtggaataaacccgtcggttcccataaacagcttatctacaaaaaactctctggcgcattttctcaccatagggcctaccatgacctgagattccgtctgatagtctccgcccaacagaatgatctttcctatggcagactcccggatatggttggcaataaatgcggagtttgtaatgatggtaacatcctttttctcatttgccagctgctctgccagcaaggcacagctggaaccggattctatcataacggtttcaccgttggctacgatctttgccgcagccttggcgatcttaagcttggtatcataccgcactgacagacggttggtgatgtcatccgtattccggactgccgcatacccgtgttccctggtcagaagccctctctcctccagcacatccagatccttacggatggttacctgggacacatccagcagctccgacaaactggtcacttccactcttttttgttcattcacaatctgcaaaatcttcgtctgccgatctgtcataagatctcctccgttctgttccagccaagcggatattcccaatgaccaagggtcagcccctccgcttggccgcctgattcggttgaattttcgtttgtagttcaattataacattatccattttcatatgcaatagaattatagggtgtactgttttcttttctattgacaacaccctaactttgctgtataatggcaaaatgaaaattaaatagtatcttcagggcagggtgcaaatccctaccggtggtaaagcccacgagccgtaaggcatgattcggtgtgattccgaagccgacagtacagtctggatgaaagaagataaaagcgcacaaatgtgtgtatcgtatattcgctctgaaatgattttatcgtttcagagctttttattttcagatacataccttcagatatatttaaatattttgacgctggtaaatgccttgaacgatctatggttcaaggcattttactttttcaggaggtgcgtgattgaaagataaagattatatgcaaaaagcattggagcttgcagaaaagggttgtggatgggtaaatcccaatccaatggtcggagcggttatcgtaaaagaccatatcatcattggtacgggttatcatcatcagtacggtaagcttcatgcagaacgggatgcccttcaaaactgcacagatttacccaatggcgcaacgctgtatgtaacattggaaccgtgctgtcattttggaaaaacaccgccatgcacggaagcaattatttcaagcggaatccggcgcgtagtaatcggctcatctgaccccaaccctttggtggccggaaaaggaattgaaatgttgcatcagcatggaattgaggttgtggaaggagtgctgaccgaggagtgcaataaactcaatgaagtattcttccatttcattcagaacaaaactccttatgttgtaatgaaatacgccatgacaatggatggaaaaatcgccacccgctctggaaaatccaaatggatcacaggggaaaccgcccgtgagcgtgtccacaaagacagacatcggtattctgggatcatggcaggggtaggcacgattatcattgatgaccccttgctgacatgccggttgcctgacttaaaaagtcctgtccgcattatttgtgacacagaactaaaaacgccgttacaggcaaaggtagtgaaaaccgcaaaacagcataaaacagtcattgcaacctgctgcacagacagcatcaggatacagacatacaaagaggcaggatgtgaagttcttctcctgccgtcaaaggatggtcatgtggatttaaaggagctgatgattgctttaggaaaaaagggaatggacagcattttattagaaggaggtcaaacgttaaattggtctgcactgaacagtggtattgttaacaaaatgcaggtttatcttgcgcccaaattatttggaggtatcaatgccaaatctcccatcggcggcacaggcattgaagcaccagatgaagcttatcagctgctgcctccatcagtcactaaattaggcggggacattcttttggaaagtgaggtgatagagtgtttacagggatcattgaagaaaccggaacagtccgcaatataaaaaaaggggcgaattctgcggtcttaaccattggggcggcctctgtgttaaaggacatgaaactgggtgacagcattgctgtaaacggaatttgcttaacggttacgtcttatacaagcaccggatttacagcagatgtcatgcatgaaacaatccagcgttcttcccttaacagccttcattccggcgccatggtcaatctggaacgggccatgccggctgatgggcgttttggaggccatattgtcaccggacatattgacggaacaggcgttattcgctggataaaaagggatgacaatgcagtttggtataacatccgggcaacaccggagattttacgttacatcgtagaaaaaggttccattgcggttgacggcattagtctgacagttgctaaagtctctgacgttgatttcagcatatctgttatcccacataccgcaaatcataccacactagctggaaagcgggttggagatacagtcaatttagaaaatgactgtgttggaaaatatattgaaaagtttctgggtaaaccggcgcaaccaacgaaactgtcaaaaggctttcttacggaagccggatattaggaggaattatgtttcaattcaacacgattgaagaagcacttgacgacttacgtcagggcaaaatcattttagtcacagatgacgaggacagggaaaatgaaggagatttgatctgtggggctgagtttgctaccacagagaatgtgaattttatggcaatacacgggaaagggctgatttgtatgcccatgagcattgagctttgccaaaagctcaatcttccccaaatggtaaattccaatacagacaaccatgaaactgcctttacggtttctatcgaccatattgataccacaacgggaatttcagcagaagaacggagcaggactgcccgtgcctgcgccagggatgatgtaaagccggaagatttccggcgtcccggccatatgttcccgttgactgcaaaacgaaacggtgttcttgaacgaaacggtcacacagaggcaacggtggatttactaaggcttgccaatttaaaagagtgcggtctatgttgtgaaatcatgggagatgacggcaccatgatgcgcaccccggaattgatcgaactggcacaaaaatggaatttaaagtttattacaattaaagcgctgcaaagctaccgcaaaaatcacgacaagctggcagaacgtgttactgtaacaaaaatgcctactaaatacggcgatttcaaagcgtatggctatgtgaataagctgaatggagaacatcatatcgcattggtccacggggatattggagatggaaagaatcttttatgccgcgttcattcagagtgtttgacaggagatgcgtttggttctctccgctgtgattgcggtcagcagtttgcggcagcaatggcacaaattgcacaagagggacgcggggtcctgctctacatgcggcaggaagggcgcggcattgggcttattaacaagctgcgtgcctatgaattgcaggatctgggtatggatactcttgaagccaatatcgcattgggctttgacggtgatatgagagaatattatattggcgctcaaatactgaaagatttaggcgctaaaaccttacgtctgttaacaaacaaccctgacaaagtatatcagctttccggctttggtatggagatcacggaacgggttcctatccaaatgaacgcgacagctcatgacctgttctatttacaaacaaagcaatccaaaatgggccatattttaaactattaaaaaggagatttttacatgaacgtatttgaaggaaaacttatatctgaggacattaagatcggaatcgttgctgcccgctttaatgaattcataacctccaagctgctttccggtgcattggatggattaaaacgccatgatgttcaagaagaaaatattgatgtggcatgggttcccggagcttttgaaattccgctgatagcttccaaaatggcaaaaagtaagaaatatgatgcggtaatatgccttggagcagtcatccgcggaagtaccagccattatgattatgtatgcagcgaggtatcaaaaggtattgcacagacagcacttgctaatgatattccggttttgtttggggtccttacaacagaaaatattgaacaggcaattgaacgtgccggaacgaaagccggaaacaagggatttgacagtgccgtcagcgccattgaaatggtaaacttaatgcgggccttttaagccgatatacggtgtaagtttaaaaagaactgaagtgctgctcctgacaggaagtcatgatggcttcctgtcattgtgcagcacttccttctcacaccttattattattgtatatcctccaaaattttacagcttcttatcagttctttttctcaaatcaaaacattcctggtttttcattgtccccatgaaataagcatgaaactttaatcagctcagctgtttctgcaaaaccggtctgctaaggttcctggacatttcatcaaggtaagtctcccaaagatcagggctgaagtccagcagcttcatggtgttatctgatgtttccctgcttaaaatttcatggaacagatccgtctcaaagcagtggactttttcctccttataatcatgatcaatcatataaatcagattcagcccttttaaacagaacactgctgctttcggctgttcgctgtttacgatcctgactttgtcagagcttttatcgttgataaaggagttaaacctccgcaggtatgggatgcgttcctcaggcagaaaatccacagcgccaaaaaggggcacaatggcttttcctgtagaacaaaagccaagcatggcatccacggtgacgagaaaaatggtatccttgtccaggatcctgtgaaaaagttccagaacagctcttttggccacctccctgcctcctgccggccccaaatccttttctcccactaaatagcctatagatatgaaattatatacggcctccatatgcctgtccatcacccttgaggggatggaagggtctgcttccaacgccgctgctgcctctcttccgctgtagcttattttcctggcatcatttctcataagcgaattgaagaatacactcaaatagcctttatgggtgacaaaggacataagaggcatcccatccagctgcaggctgaaaagaaggagaaattgaccctttaaaagtaaaaagaggcagttcatttcttttgtggttttccatagattcaaatccacatactcctgggccctgacaatggaggacagaagaccggtattataatcgccggaggacgtttctaaggaggtcatatcaaaaaagtggttaaagacggccctttccccttttcgaggatttgctatttttactctttggaaaatgtcagaataataccggtcaaaaagggggagggtgctgtaaaactccaggggaaggtcatgactgcccatgatgtgatcggaaataagcacacagaacatgttcaggatggtctttttccccagaaagcttgcttccctgtcgggataactcatatttccattgttctcctcgtcaaaatctttatcaaaggcatactcaatggcataagacagaaacatttccagttcgtatctggaactgaaatcatatatgaccggaaaaatatgcataaattttaaataacagccatgtccatacagaacttctgcaaaatatgcggcggcctgccggcaaaatgccctcttttccttcagaaaaggcagccttccccctttcagaatcttgcttaatccacttggagtcatgttcatgctgattgcaaaatctgttttcggaatatccgcaatttcgatcaaatcctccagcaatttaccggttttcatttcctgatccccactttttcttattttggaaaatattgtaacacgattttttctttttgtctatttcggtgtaactttttttctgcattttcaagcaccaataaacaggaccttatataattttaacaggattcctttcgccaaggcaagcagggccggcggcagaggaatcactttaaatataaagccgcgattctcactcaggcacacgcttgaaatcgaatgaagggcattaacaaaaggaggaatgagaattgaaaaaagggaaacaaaggcggctgatcagctggctgttgatcctgatgatcgtgttgaatgtgttttcgccgctcaatacggtatgggccgaagggcttggaatatcagatgaaaacgcagtcagtgcggacacaggaacaccttccaatgcggacaaagatcctgcggccaccggcaatgagaaaaccgatcccacaaaaggaacaccttctgatgcggatcatggtttaagcaaaggctcatcaggttctccaaaggcaacaccttccggtgcaatgcctttgctgttgaatgcagggcctcaaaagctgatcgactcagcaatactggaaccggaaattgaagtaaagaaaaacggttctccgcttaatgacggtgacaccatcataaacacggataccctggatattaagtttaaaataaaggtaccggtaaaatatgatactcctgaaccgccggtatatgtcagcaaaggcgatactgccaccgttgaactgggcaaaggctttacattagctccgtccacagcagtgctgaagacagatgatgggactgtcatcggtcatgcaacgctgtcagccaatggggaaggcatgatgaccgcccagatcctatttgactgggatgacagtgttgacgatgaagaagaccctgcaatcaacatagcggccggtttcaacgcaacattgaaatacgatgaaagcaatgcggaaaccgaaaacggaaaaaaggtcattaaaattctggaaaagacctttatcgttaccactccggccgccgagattatttataatgtaagtaaggaaggcactgtaaactggagtgataacacggtggaatgggaggtcgtgatcactgcaacacagggcggtagctccgttgacttagagggctataagttcagtgataacctggctgctgtagggacgtataaggccaattcattgatcgtaggcaccagttctgtcacacccactgccctatccccgcttacatacctcttccccagcggctctatatcgccgcagactgtaaaatttaagacagaaatcccggagagtaaatttttctccaacagcgagccctccatcacgaataacgccaaactcttaaattcagatgaccaatctgtgaaggaaggttccgatacagtcaagcttgaaaagaaatggattactaaaaagcatgttaagaccaatgatggtacaggagatatttataatcccgcaaaccgtaccattgaatgggagatcatcgccaaccagcgcggggccgacctaaagggtgttgtgattaccgatattgccgataacgggcaggccatcgattcggtagagttgtttttttctgatgggtcgggcggctggataaacaaagtcacccttacccctgatgcagaaggaaagatcaccgtaggtgacatcaccactcccatcaggctgctcgttacaaccaaagtgccggatgatgcaagcggttctgtatcaggcataaaaacgtacaacaatcaggctgccatcacatggacaggcgtacctgacggcacggttattggcaccggaaacgtgggcattggggtcggttataaccccatttcaaaagatggtactctggtcggcagcagatcggaccgccagattcagtggaccgtaacggtggaccctaaggggcaaacacttgcttcccccagtcaggctttaaaggtctacgatttgttggtttatggcaaggataatgctggtctaagcggcagcaccggctggccggaagacatgaatcacaacagttttactcccagctttaaccagaaatatatcacaggaagctttgcgaataccacaggaactcccagtctgactaaagtctatacaattaaggacagcaacgatgcccccattgccgacttactggaggtctcggtagataagaacgggaaaaacagttacaccttcaattcccaagtggtaaacccggcgatctttgccggaaatgaaacaaaaagtgttcggaataccgcttccctgttccgtgataccacttatttaaactccaattataaagatgtagatatcacaaacaagattctcaagaaagatattctaaagcgggatacggaagtaaacgatgctgccggcgtcaatggaggaaacatcggcgatgctgattccggatttgaccatgaaaccaaaacggcaattttccgtctcagcgtcaacgccgacagcctgaatttcactgatgccgcaggaattaacagcggtgccgttacaattacagatactctgccaaaaggatgggtatttgacaagaccttttacaagattttcgaaggaacgacaacaggaggtacggtgaatgcagataatgatgtaaccggtacgatcggaatcattccgtcctttacagattccaatgaaaccgatggtgcaaaagcgtcctttgtcttcaccacactggaccggccctatgtcatccttgtaaaggcccagttgaccgacaaggcctacgaagagtatttgcagtcaaatgattcacataagacagacctcaatacggttacgcttagtgccgaaaaatggacacattctgtaaccgccacccaggatgtaaagatcattaccagagtactggacaaaacattcaagttcagcgaagaggaggcaagactgacctggaccgtagattacaatccctttgacttaagtcttacaaatgtaaaaattgaggacaccatgtcagaaggaatggaacttcctgttgattctgcaggcaagcccgtatgggacaatattacgattaccaagatggttatgggttcagacggaaaattgaccgcagccggcgatacggtgaacccttcaacctgtgtcacctatgatgctgcgatccgtacgctgacctttacggttcccgatgtaaaacaagcttaccgcctgacctacataaccgatattacccttgaatcaaatggacaggtcaagaatacggtcaagctgacaggcagtgaagccggcggggcaaacacaggccagatccatcccgttacctatcagagcggatgggcgacgctggaacggggaggcaatttaaccatcactaaagtggatggctccagtcctgccactcatctccagggggcacagttcaccctttatgcacaggatggggtaacagtaatccgtaagggtaccacaattgctgacggcacgcttaagatgcgcgcaatccctgttggaacttatactttaaaagagacatcagcgcctgccggctatgcacctgacaccaacgcttatattgtagttgtctctaagggaacagataacaagattaacacctccatcagcggtaaaaccggggaaagctccaataaacttacggtaaagaactacctggacggctctgctgttgattcagggagcctgaccatttcgaaaaaggttgtgggaaatgcagacgataagaccagaacatttgaattcaaattgattttaagcgatacagacaacgagtatttctataccggaagcggggtcgcagacggatttattaagagcggggatccgatttatctggcagatgggcagagcatcaccataaccgggcttccaaaggatattacctatcaggtgacggaagaaaattactccggtgatggatatgagactctcagtacagatgaatccggtactatcgttgccggagagaatcagacagctgcctttatcaacacaaaattcaagcccggaagtctgaatatcataaaaaccgttaaaggaaacagcaaggaaaccggtccgtttgagttcactgtaaccttcacaaaaccggacggtacaccggatggcaatacatatcactacagctacgccggatcaggtgaaaccagacaaattaagagcggtgataaaatttctctctctcatgggcagatcatcaccattacaggacttccaaaggatactcattatacggtagctgaaaaggattattccgaagacggctatgccacttctgtctccggcaatccatccgataccattgaaacagatgcagcaaaggcagttacctttaccaacacaaagtacattggaagcctgaccatcaaaaaaacagtcgcaggaaacagcaatgaaaccggcccgtttgagttcattgtaagctttacaaaacccaacggttcaccggatgtcagtacatataactacagctataccggaacagatgagatcaggcagattaagagcggtgacagtatttctctctcccatgggcagagcattaccatcaccggactgctaaaggatactcactatacagtggctgaaaaagattattcaggaagcggttataccactgcctctgatcaggcatccggcaccattgatgcagtcacggagaatatagccacctttaccaacacaaagcttttgcccggaagcctgactatcagtaagaccgttgcaggaacaggagccagcacaacaaagaaattcgattttaaagtaacctttacaaagccggacaaaacaattgatacggctccttacaaattcaccggaaaaggcgaattcccagccgatgaaattaagagcggggacacgatttctcttgctgacggggagagcatcaccattactggactgcctgacggtacgggatatcaggtgactgagtccgattattcttctgaacggtacactgggaccaaaacaggagatgcaggtacgattgacacgcttaagacgtcagttgcagcatttaccaacacttaccgaagacccactggcggcggcggtggcgggggtggcggcggcagtgaacccaaaccacagcagccctctccgacaactccctccggaccaggcatatctcctccaacatcaacgcctgcggcagcacccacgcaaaaacccagagaagaaatgactcctcaggaactgtatgacatatacggcgaagtgccgctgggctatatggtagacgtggatgggcagcttattcctcttggccttccaaaaaccggggatgccggatccggcgaaatagcaatttacgtcctgctctgcttctcagcaattttaggcttaacgtcttccataggcatactgagaagaaaacatgttgacaaatagctgctaaaacaaatttaaagaaaacatctgttcaataaccagatacctcagaaacaggattaaatctaataaagaaagagtgtcttaacagccggcagatattaacctggcgactttagagacactctttttgtataccgtatctgaatccatttttgctaacaagggcagtcaatgatggtagcccgaagagtggaatttctaaacagcgttgctgcctccccaatagcagactgaactgtcagaattgcgtaataagtacagcatccttcctttttgtctaaacaatcgtgaatatggaaagtaaaggtgttataattggattccggcaacgcatgttccagcagccatacagggccaatcgggatttgggccatttggcaatcacattgtttgtatatctgaataaaagcagttaataatgattcaggaaatacagtattagtagaaaattccagctcaatacatggatgattgaacttttcggtattaattgataaagatacaagtgtgacagtggttcccgccggtgtttcatcagctatggaaacatttgacagagagctgcactttgaaaagatcctgccgcacagctttccccaacggcatttgcatacgaacggatttatatcattgctgcagaacagttgtttatcagctgaacaataatctacagaaaccaaggcacttaaattggcattgttaatagatattgtgccttccgtgacagctgaggcaattgttacagcaacataataggcacagcactcatcatatatttcatcacatgccttgaaagaaaatgcaattgcttctgagcttataaatatatttgtgtaactccagactgaacctacaggtataggtactatctgttcaggacattgcttgaatatctggaagttgaccgtcccaataaatgcatctgtaaccaggttgcttgaaaaattgaatcggattttagattttcttccgtgtgaactgtcaataataagggatgtaatacgaaaagacgtccccacacttgtacctgctggaattgagagggtatccgtcgagctgtagcttaagaaggcatcataagttactataagattttcagttttgttacaatcacatggcatatccagcatcaataacctccatttatttgtgaaaccatgaaggactcactctctttatggtatagtattatttttttataatgtatgtgaatgaaaacttagaaaaacacagacagtcaaagaatggccttttcagattagttcaccaattatgaatcaccttagccggttttattaatataatgtaatataaataaattcagctataatattcccagaaaaacggaggtaaaaatatggatgggagacaatgttgtttattagaggattgtcagggaaaatatgaaaaacgtaataaatttttaataaaatgcagctcatctaataatctgatcgtaccggccggcattactgcgggaacaacttacattgttgcatcacttgatctggacttagcttgcttttgcaatccgtctgtcaatctggaattcagcagtaacattctctctctcatttcttttatagaaattgattttcaggttttcagacaatgtaaaaatgaattgagcccgactgcagtcagttctatatggacatataattcattgacgccgggttcaaacagcagcacatttacatttttatcttgtgattgcgatctcaacaattgtagctgttgtacttacacggttattgcaacaataagatccaccgtggaggctaatcctgcgactgttaataatgcaatgcttgatgcctttgttacagaaaatttggtctgctgattgttaggtatttgtcagagtgcatgataaatataagcatgaaaaaggaggccccatgtcatgaaatgacagaaagaggcctcttatttataaaacactttcatttctgctgctgcaaatacttgctgatcgtcctctgaaatattttcatgctgctgtcaacattcttattttcctgcaggatctttgacacctctccatcggccagattcatgacctgctgatactgcagaagtttaggctcaatgatgccatcctctatcacattatacagaagggtgctgctgattacctgttccccctcatccatatcttcctgtatgatattcgccccttccttagaggaagccacgctttttaaagccggaactccctgggaatacaggtacacatccatttgcatctcttctgtgtaagtcagctgctttaaaaattcccatgccagtttatcattctttgttttgctgttgatccccatcaaaagagcctcaacctttgatatgttttctccttcttttccggcaggaaaagtgatgcagtcccattgaaatctggtgtatttcttgatccggtaaggataggtcttgtaggtgcggtattccgcaaaggtcaaaggcatgaaggccaccctgccctcattaaaatcttcctgagtgacgctctggccctggtttaagtcgctgagccgcttaatgtatttgatggcatccagcacccggctgtctgtaaaggaaagctggtcctgattctcgtcatacagcttgcctccgctggtgtaaaaggcatcccgccagctgtaattataagtgccaaactgatccagaagtccatccttgtccgtgtcctttgtcaccttcctgcatatttcatacatatcctcccaggtccagtcctccttgggcatctggatcctttccttagccagcagggacttgtttacaaacatgagagacggaacagtttcataaggcagggcatactggcgtccgttgcgacggcccgtatttaaggccgtagtaaaaaagtcctctttatgaaactccccatctcctgccatcatttcgtctaaatccttcatgactcccagggaagtgaatttgtcaaagtccgaatccagtatcataaacacatccggcatcttcccctccaaaagctttcgggcgcaccattcagaatagtcctcctttgcgattccgctgtaataatggatcttcacatttggatgagactcttcaaaacgtctgactgccttgtctatgatcttaaagctgttggcactggccacatcccagttgcttcccgtaaacatgccgaattccagaattatttccctgttctgactgcggtaaatcaaggcccccgttatcagtgcggctatggcggcactgatgcaaaggctctttttccacttccccattcccgcttcccctttgcctttgatttgttattgtcttctatactctgcacttttttgtttctgctgctcttttcgttttcctcttacctttattaagtctctacccgctttctcacattggtctggaccgcccatatggcaagctgagtcctgtcccttaaatccagcttgtttaaaattgtgcttaagtaattgcggaccgttccctcagaaaggttcaaagcctttgcgatctccttattgctggcccccttctccacctgggcgatgatcttccattctgtcctggtcaattcctccatgttcttttccatgactgatatggtatcatccgcctgggccatctgggaaaagaaacgcagtacctttgccgcaatatccggattgatcatggcccagccgttgtaaacagtggttatggcccctaccagctcttccatggaaacaccctttaacatgtatccgcttgccccgtattttaaggcgttatacacgtattcatcatcatcaaaggtagtcagtatgatgatcttgatttggggatagctttcctttatgatcttcgtgcactgcactccgtccatctttggcatccgcacgtccattaaaatcacatccggcacattcttcctcacacaccggatcacctcctggccgtctgcggccacatcggtcaccatgatatcctgtctgctgtttaacacgatctgcaggctctgacggatcaactcctgatcatccgcgatcaatactttaatcataggtctcccccctccgaatcggtatccttgcgttgacgataaacccattgcttccgtcaaacgtcacaactccgcttaacatcctgatccgttctttcatgtgcttcgtgccgaagccgttctttatttccttacagccgattccgttgtccttgatctggatcaggatgtcctgattttctctttgtatggtgatccatatctccctggcgtgcccgtggcggatagcattggtaatcccttcctggacaacccggtaaatggcattttcctcatcttcatcaaactttaagttctggaccttgcagtcaaaatatacccttgtctcagacaccgcattaatatccgtgaccattttattaatggcatattccaggctgaaacggtccagggcatcgggccttagttcactgacagaacggcggatatcctttatcccgtctctggttaccttggagatcagctccagctgcttctttgtctgatccggcgacgtcccgatgatggcaagacaggcatcgatccccgccgcaatcccggtcagggtatggcccagggtatcatggatctccctggccaggcggtttctctcccttgtctcagccattttttcagccataagggaatatttttgaagctgttcgttgacctcctgaagcttttcattaagcccatggatctcatctaagtttccctgctgctcattgatgatattgacacaatatacaacaaacacaattacatttaaggatattaaaatattgtatacacttaaaagatactgctgcaccgacgcactgtaataggaaatataatcctgaatggaatacaggcggtaggaaatggacaaaagctcataatcagccaatatgaagcttccgatggcaacggcagccaggatatacctggactttccgtttttcacatacataatgacgttggaaaataccaggagcaggattccgttataattaaaattcaaaaggatgatgatcccaaagcagatgaggaaatccgccaccagactggtgaggatgaccttgctgttattgggaaacaaacggtcccggatcaccatgcttaaggtaagcagcaccaataaaagggcgcagagccagatctttgcataaggataccagacaatggcctggatctcgtttaagaattctcttgcagcgtatgccctccggattttttcaattgtccagtaaataaaaatgctgattcccatgaccgatatcatgtttaaggccaggatgcccacctgaagaaggccgatccggctgttaaattttttctcttccatctctctacctactgccagccgtcaatttcgtaattatcaagattgtcctttgtaataagggtgctgggaaggctgatgtattgatccaccggctcccctgccagataccggtatgccgtttcagccgccaccctgccgatggacttgggactctgggcactggtcccggtaacatagcccatatccagaatggccttaaaatcaggggaaccgtcgattccataaatcaggatcccctcctctttcctggcctgctgcaaagccgcaagagctcccaaagccgtgggatcgttgccgccaagaatcacatcaaaatcaatgtttttacgcaggacctcctccatcaccttggaggacacctcaatttccccgccggccgcatggcggtacaccacccggtagttgccgtttcctgcaatggcatcggtaaatccctgggcacggtaggtgatggacatttgtatggggttgtccagaattacaatattggcggatttcttccgcttcatcatatccagggcgcaaagctggcctgcctggtaattgtccgtttctatgatggatatgacagaatccctgtcctttacaacggtatccacattgatgacggctactcccgcctttttgcacgcatcaagggcaggagaaacagcctcccagtccaccggattcaaaaacagcatgcagatcccctcatcgatcaattccatgatctgttcattctgcttctcctggtcctgaagagggtccctggtgagaagaatatccccattggcctcaaccacctcttcgattccctggttcaatatgtcaaaataggggttgtttctggtcatataggttgctccgaaaagttgggcctcgtgctgcctggtcctgctctcattcctctggcagccgggcagaagggccaatattccaatgaccagaaaaaataatcctgtccttgccttcatgcttttcacttcccaatttggtttatttactgtaacgtggatagtataccacaaaaagcgtctctccgttaaggaaacgctttttgcaaggacataaatttaatccttctttttgtttcttaaataatcgatgaatacagccagaagaatgacgatgcctttcaccacatactgccagaaagaattgacgttcatcaggttcagaccgttgtttaaaacaccgatgataaggccgccgataatggttccgccgatcttgccggaaccgcctgccatggaggtgccgcctaccacgactgctgcaatggcatccatttccgcaccgtcacctgccgtaggctgcccggaatacatacgggaggccaggaccactcctgcaaggccggccatgatgccggaataagtatgaaccagaagctttaccctggccgtgctgataccggagaatttcgccgcctgggcgttgccgcccaccgcataaatgtgccgccccagctttgtcttattcataattattgccgtaataatcaggacaaacaccaaaagtatgacaggcgtgggaattcccccgatgtaaccggcgccgagaaactgccatgcctttgtaaccacccgaaccggggagccgccagtatacacatacgccagaccttttgccacgttcatggtagcaagggtcacgataaacgggggaatggtcgttttggaaatgaccacaccgttcatcattcccactgccatgccgatgagcacgccgatgatgatggccgcaaatatgggaagattataacgggctacacagcctgccgccacgcagccggacaaggctatgatagagcctacggaaaggtcgatgcctcccaagatgatgaccatagtcatgccgcatgccaggaataagtttgatgaaatctgccttaatacgttgaacatgtttttatgggaaaggaaggcgctgctggtctttggaaatatggataagaaaatacacaggatcagcaatgccccgataatgccgatattgtctttcaagtattgttttatgtttttttgaagtcttgttgtcatttgattttccccctctttcctactttgcagccagcttcatgatctgttcctgggtaacgcattcctcatggctgaaacagcctgtgatcctgccgtcgcacatgacataaacgcggtcgctcatattgagtatctccggcagctcggaggaaatcatgatgatggacatcccgtcctttaccagatcattcatgattccgtaaatctctgattttgcccccacatccacgcccctggtaggctcgtcaaggatcaggatctttggcgaggtggcaagccatctgccgatcatgaccttctgctggttcccgccggataagtttccgatcaactgctcctgggagggcgtcttggtatccatcatatcaatatattcctgggtaatgttttcttcttttcccgaatccacccagattccttttataaaggatttcagcacttcaatggtagagttaaagcggaccgtctgtaccttgtaaattccctcctgcttcctgtcctcaggcaccagggcgattccgtacttcatggcatcaacaggggatttgatcttcacttccctgccttccacataaatctctccggtaaagccgggggtaagaccgaaaatgcatttcatggcttcacttcgtcctgctcccacaagtcctgcaaatcctatgatttctcctttacgcagttcaaagctggttccttttaccatctttccgtctgcaatgttttcacattttaataccacttcccccggttgtaagtaatcacgggtgtaatatttggtcagttcccggccgaccatcatggcgatcagcttatccctggtggtatcctgaaccacttccgttcctacgaacgctccatctctcaataccgttaccctgtcacaaatctgctccagttcatccattttgtgggaaatgtaaatgatccccacgcccttctctgtcagcgtccgcatggtccggaataagaattccacttctttatccgaaatagaggaagtaggctcatccatgaccaggatcctggaatgataggaaatggcctttacaatctccaccatctgctgctgggcgattgtcagattcttcactaatgcctctgcagaaatgttcatttgataggcatcaagtaatttctgggcttccttttccataatatcatggttgacccagccgccctttccaggctcccgccccagaaagatattttccgccacagtcatatgagggaccagcaccagctcctgatggataatggaaatgccgcttgcatgggaagcatttactccatcaatgaccaccttctggccatcaatgaaaatctccccctcgtccgcaatataaatgccgcccaaaacctttatcaacgttgacttgccggctccgttctccccaagaagcgcatggacctcaccggtacggagttctaaatccactccctgaagcgctttgactcccgggaaggatttatgaatatttttcatctgaagcagaatcttttcgctcataaactcacctgcctgttctcacttttgctttgccttctgggttttcccgttaaaaagcgcccggagggcgtcccaaaagcaatgtttctcctgttttgagacgccctcccacagcactttctttattcttactgccagccgtctgttccgtagtctttaacattctcagatgtgatcaggaaggtttctaccggataacggtcatctactgtatcgccatttaaataagaatacattatatttactgcagactgtgcgatcttaaccggtgactgtgcgccgcttccttcaatgagggaatcgccggaagccatctctgccttaatatcaggagatccgtctacgccgtagatcttgcagtccttaatgcctgccgcattggctgctgccagtgctccaagtgcggtggggtcgttgccgccgaaaatagcaactacatcgccgtgtgcctgaagaaggtcttctgcaatgcccatggcaacctgtaagttgccctttgcatcctgctgggcaacgatgttaaagttatgtcccttgatcgcatctaagaagccgttggttctgtccgtcacggaattcatggtaggggaatccagaacaatgatatctccgccgtccggacatttcttaactaagtcctcgccgcatacgaaaccggcattatagttatcggaacctgtgtaggaaaccagataggataagtcagccacttccgtgtcaaagcctacgatgggaacatttgcatcctttaactgatccagggccggaagaataccttctgcctcagccgggttcatgaacatggcatcaatattctgggaaattaaatcttccacctgggtaatctgaagagttacatcattggccggatccacagaaataagctcatcaccctgggcctcaaccatttcccgcatggtcttctcaatggtaacgaagaacgggtttgtgccatccatacaggtatatccgaatttgtaatgcttgcttgggtccttcttctttacattggcatcagccatgtttgcaccggaatcggatttaactggtgccttcgtctccgcagcggcagcggcggttgttgtctctgctgccgtagttgcggctgccgttgtctcaggcacttttgtctccggttccccattgctgcagcctgccagtgaaagtcccgcaagtgctgcacaaaccagcattgcagctaatttttttgtgcttttttcatgttacgtcctccttgtacactttttatttgttttaattgctactttttcatcatatcatgacttaatttttaaaacatgtgcacaatgtaacaagttttatgtgacaattgtaacatctttatactgccggatattcgttgcaaagaagccggtagggaggctcatcctcttctatctttggaaaacgcccggcaggtaagtaaaaccggttatccccgttgtcgtcgttgcacatggacacctctcccaacaggacaggaccggttcccggctccagttcaaaatcgtggtacagatagggatatatggtaatactttctccgggacacagcttaatctgggttcctgctgctaccttgtattcccttccatcgctgtgaatgttcacatcctcatgggcaaattccccatcaggggtggactggtagacacggatcagcacatttccgcctccccggtttataatgtcctccattttattccagtggaaatgcatggccgcggactgaccctccttaatataaagcagcttttccgcataggtcttcggatacttctccattttcacattgccgtttcgcagggtgatcagggaaaaacccaccttatcaaagtcgcccattccaaaatccgtaatgtcccaccccagcatgttgtcacggatctcatcatagtcatgccctttttccttccactcctccggtgtaaagccgcagaaagggggaagggcaaagccgcatgtctttgccatctcttccatatcctttaatgccttgttgatttctgaacgtttcatttaggacctcctgtcccttcattattccagattggaaaatacctttatggtatgaagcacatcctttttcattgcctcgatcccccataaggtcacatcatgataatatacgtagccctccgcctctatggccttttccttaacatgcattccgcctgctttggctaaataagtatagtaattgatcttgcggactccgttttcaatgcacctgcggaaatcctggtcactgacaccggagcctccgtgcatgacaatgggaagcccgatcctgtttcgtatctggctgatccggtcaaagtccagcttgggttccgtaatgtaaagtccatggaccgtgccaaaggagcatgccagggcatcaactcccgtagcctccacaaaccgttctgcctgctccgggtccgtgtaacagccttccgtggcttctccttcttctccttccccaatgcttgagaactcctgccttcccatggcgccgatctctgcttctacagaagccccatatgcgtccgctatttcaacggcaattcttgtattagccgcattctcctcaaaggacagggcggagccgtcgtacatgaccgaagtaaatcccatatccagggccttttttaacaggtttaaatcatccccgtgatctaaatgcaccgctaccggcaccgtggcccgttccgccatcatgaccataataggaccgatgactgacatggggatgatggtctcgtgtacaggggcaaactgtaagattacaggctggttcagttcttcagaaacctcaagcactgcctggatcccttccagggaagtgatgttaaatgcccctattgctatgttttttgcatccgccagttctaaaatagccttcattgtgatcagcatatctttttcctcctgatttttatttttttgttatggatgaataattttttgttgttcccatcccttttgtatcttttctttaagtgtctcaaaaggcagaagtccgctgacggcatcatacgccgtcacgcaggaagccccggttgccaccgcaagctccaggcattcctccggccttaatccctccagcatggcctttataaaagcggcaatgctggtatcccctgctcctgttgccgacaggatcttatcaggcacaaagctgttctgaaaacaggcaatgccgctccagccctccataaaatgcccggcagaagtctttaaatacattccggctgccccgcattttaacaatacggttttggctcccagctttaaggcccggtccgcaaggacctccacatcctcgtttaaggaaagtatggatgtgatgtcctctcctcctgccttttcctgccatttgtcatacagttccttatcaagcatgtaccccagttcctcaatgcttggaacaaagaaatccacataaggaagcacagatgccaggatcttttcccagtcacagccggccgcctcagaatcaggatccactgccgtcaaatccagggatgtggtaagggaaagctccttgacccgacgaaaaagctcaaccagctcctctccctcattctgataaaatctgcgcatcagcgttggatatccgaaatgaaaatgggctgccccagccacctgctcaaaatctacatccccgcagcaaaacgtatcattgcaccccggatcatggagaaaaaaccggtcaaatcccttgggtgctatgaccaccgtataggaggtggattccccttccactgccggaatgctgctatcacagccgctctgtctgatcttttcctttagtatcaggccgaaatcatcatttccaacctttgccatcaaaagcacatccccgcccagggcatggagccccaaacccgtattggagacggctccgcctgtggatacctgcgcctttcccacccgcaggagctttcccggtcgcagcagtgcagaaaacttctggccgccgctgtttttaaaaaccggcgtaatgtccagggaaatatgtccggccaccacaactttcttcttcccttcctgatatttcatgttttaccccctctctctgtactcatcataacaattccaaaggaaaagtcaatattttttatgcatttattactattgtaatgaacaatatgacatttgtcatgtatatattgcacaacacaaaaaacgagtttctctatctcacgctgtagggatcttcatagggaccggtcaagaggatattcccaatccgctccgttgtttcatacttttcgcattaataatggagtacttcctggattcggtaaaaaattcacttaaaagcttttcattttctattaaaatgattttgaattctatcattaacactctttttctttagattgacaaacaataatcttgtattatataatgaacaatgtcgatatttgcctaaaaatggatgaaacggcctgttttgtaaccgccatccaccgatgttcacaaaatattaattcatatagtataccaaacggagcttcagacgttgtaatgcgtatacaccagttcgtgttttgaggaacatgacagaccaaattgaagcgattatacataagaaactgatgagaaaccaggaggatatcagtatgaagaaattcagggattacagtattaccaggaaattacttacagcctttcttggcatggtattaattatgcttgtaatcggcagcatgggcatatttggcatggcccgcatcaaccagatggatacttttttgtataaaaaccaaacagctcccatgaaagacctgatctttgccacaaaaagcctgtatcagctccgtgaagattccaatgccatgatcatccatgccggcgataccatggagctggaaactctggaacaacgctatatagaatcaaagaacaacttccttaacggttctgccgcataccggaccagcattcaaaactcggaagccctctctttgatcgacgaagcgacccagctgtttacagatacctttgatcccgccatacaaaagtgcttaaacacagccaagcaggggtctaagaacacggcattgaccgcttttgatcaggataaagacaaaatccagaaaatatatgataatttcgaccgcctggcggagatccggctggaagatgctcaccagaccagcaaaaccaatgattcaaccgcaatcatcctcaccgttatgctttgtgtcatccttgcagcaggaacagcctttaacatatttttaggcttccggatctcccatatgatcagcctgcctattggacaggtggtaaaggctgctgataaaatcgctcttggacatttggatgtggatcttacggatgtggattccaaggatgaaaccggccagcttgcctctgcatttacagccatgctggaaggcattaaaagccaggtgctcattgccgaaaaaatcagcaacggagattttacacaggaagttcctctccgttccgaggaagatatccttggccttgcactccgtaaaattgaaaaggatcttaacaagaccctgcttcttataagcacggcggctgaccaggtttacaccggcgcagagcaggtatcctccgcagcccaggccctggcctccggttccacggaacaggctgcaaccgttgaagagcttaactccgccattaccacagtagcaagacaggccagccagaatgcggagaatgtccgcctggcatcttcatacgtgaaacaaaacggaaccggagtgacggaaagcaattctcacatgcaaagcttaaatacctccatgaataagatcagcgcagcttcagaagaaatttccaatattacgaaagtgattgaagatattgcattccagacaaatattcttgcattaaatgccgctattgaagccgcccgggccggaagtgcaggaaagggatttgcggtggtcgcagatgaagtccggaaccttgccacaaaatctgcggaagcggcaaaagaaacggcaaatctcatcgttcattcctcggaagccgttaccgagggcaagaagatggcagccaacgccgcaaggatccttcaggaagtaggagaaaaatccagccttgtggaacaggccatccagggaatccaaaccgcttcttcggaacaggtaatggcaatcgaacagatcaatcagggactgtcacaagtatctgcagtcatacagacaaatgcagctactgcagaagaaagctccgcttccagcgaagagctgaccgcccagtcccagaccctgcagcaggaagtggggaaattcaaactaaacggagaacaagttgattttcatgaagagtacattccttcctccaggatcacggaaccgggatcatatacaagagcggaaccaacctatgattattccggaaaatattaatcaagaaatacattctcatattacataagaaacgcagggcattggcggatgatccgtcaatgccctgcgcttctttttacatctcttcctcataagccgtatcaaaccattccagacacagctcatgccagttttcccatgccttctggcactcttttttcagctcctcataccggccggattcctcccactcttttcccttccaaaagtcttccgattccagccactcatccttcagcccttccatggcggctgtcaattccatcaccaggtccctttccggcaaaagccgctccagaaccaggccaagcttccattccagataagcttcctccaccggtatctcttttaaccggtgccgttctgccttgggaactccgcgcattccggcgatcaaagcctgctcctccgctttgatctgcgctgcgattcctcctccccgctctgcctttctgcggccttccagataatgctcatagccaaaaggatagtaaaaggcagactgattctcaaatatgagaaccgactccgccacccggcttaaaaagtaacggtcatgggatacgaacaaaatcgttccagtataagcccggaacgcggattccaaggtctcctttgccctgatatccatgtggttggtaggctcatccaggatcagaaaattaggccggctctgcaaaagctccgcaaggacgagccttgccttttcccctcccgacaaaaggcccacccgttttcccgcctcttttccgccaaacagatatgctcccaacgtgcttcggacttctttttccgttaaagagggaaagagatcatgaaaatgctgtgccacggatttatcagaatcaatttccgaagaatgctggtcaaaataacctatggtgatctgatttcccagggaatactccccggaaacaggagagataaggcctgccgcagtctttaaaaaagtgctctttccggccccattgggtcccaggatccctatcttctgccctctgcggatcctcattgtcagttcaaggagagggcggtcatagccgagttttaagtgctccgcttcaaagacccatttgcttcctaaaaaagccggctccaagggtcctgtgaacatgtggatgtcatcctcctccggcttcactgcctggcccagcctttccattgcctttcttttggacctggcaaatgcggccttatttggcttatgcttaaaccgttccaccagatcatttaagcgcttcagctcctcctgctgccgctcataggcctttgtctgtatccgtatggcctttctcttctcttcccggtaatgggtataattgcccggatattttgtcagttttttacctgacagctcatagatcaccgatgccgtccggtccagaaaaaagcggtcatgcgataccatgatcaccgctttttcatattgatccatatactgctccagccactctgttgcctggatatccaggtggttggtcggctcatccaagaggaggatatccggctttaacagcagatggcggataagagcaatcttcgtctgctccccgccggaaaactgggaaagccttttctttttatcttcccttgtaaatccaaacccggtaaacagcgtatcatattcccgttcatactcaaaccgttccattgcaaaggaatccgcaaaaggacaggaggacagcagctcttcccctactgtcctgcccttatcctcaaatgcctgctgctttaagtaacccaccgtcaattttctggagctggtgatccccggaccttccctcttgtcatcccggtccagttccaattctcctgctatcagccttaaaagagtggtttttccggctccattgtttccaactaccgctatcttttccttgccatgtatttcaaaatcaatatgtgacaggatcaggctgcccccggcagtgactgtcccatcctttatctgatacaacatttcaaaattttcctgttcttaagtattattctgttccggcttccgtttcccataaaaactataaggaatcatgaacatgtgcatgtgcctttctgtcccggatggactggagtaccggcaccaggaaggtggctatgaggcctcctgcaaagccattgttataaaggttcataccgccgtaaacaatgcctacattaagcgctgcggcagaatgaagaaatccggctataatccccgcaacaacaccgaactcaccggcaatgggcgcaagggtggtagacaataaaagtgccagaagggcactgggatccgtaatgctccagttctggaccaagcctcccagaattactcccatcataatggggaaaatgtttcggatatgctttcccgttgcgctgaagcctacaatggtgaatattcctccaatagtcggtccgtttaaagctcctcctatcatgacaaggataagggttgacatgacaccgttaatccccatattaagaagagtaggtgcaaatccttcgctttttacataatccgtcccgctgaggccgtatgtttttagtatgtccagataacgccttccaacattctctgacagcagaaatgcaaaaattatcatgccaaagaacaaaaacagaagcagctttgcaaaaagctcattgtttccctcagaccagatgagccttgcctctatattaattccaaaggacttcatcagggagacaataacaacagcaatgattccagcggaaaaacccacattataaagagaatatcccttgtgggcgtaatgcgtatgtgtggataagggcggaagcacaaatccaatggccaatccgacaagaatgcttaaaatcagcctggaagccagatgcagattaccgatctgcatgatctgagtaatgatcggtgacaaagaagtcccgtaaaagccaacatagatataacgtgttatggaagttttgtgataataagaatacaggcaaatccccatcataatagcccatatattcatgatatttttcccgaaaagggaaaaaccaaacatgagaaagcatgaggttatagtatggccgctcatctccataccaagaaaatacacaattgcaatacttaataaggtcaatacacccgcattaacaaatgcagctcctactccgccaatagcaaaataatccgtaatcaggaaatccggttccctgacaatcgtaataatacccctccaaattccatcaaacggctgcagaaagaagcctgcaacaataaaataaatcggcaccagggcaagaatctgaaatttcgtccgcctggacagcggtccgcaatttcttactttaaatgaaggttgtcctgtcatgtgtcgtcctttctcccatattaaatttttaattactgaagtattttatcatttttaaaaaagaggttcaacactttttttcggttgaacctcttttttttttgatgcaattatttcctgttttcttttatgacctttgtaagctgtatgattgcggtcgggataaccgcaagtccgtataccatgccgatctggcccccggtaagaggagttacggaaaacagcttttcaagaacaggtacaaacatgacaaggcttaataaggaaacgcctgccaggaatgctcccaggctgtaccagttggttgcaaagcccagccggaaaatagaatggcggcttctgcagttaaatccatggaacagacgggaaagggtcaaggtacaaaaagccatggtgcttgctgtggcagcactgccctgtcttaagcctatatggaaagcagtcatggtacatgcggcaatcagtccgccctgaaccagtatcttaagtaaaaactctttcgtcaggatcccttcttttggatctcttggcttccggttcagaaggccatgctccgcaggctccataccaatagcaatagccggaagggaatcagtaagcaggttaatgaataacagatgaaccggggcaaagggaacgggaagggccataatggaggtgtaaaggacggaaaggattcctgccgtgttgcctgagagcaaaaactggatggcattttttatattccggtacacgttacgtccattggcaaccgcctttataatggtggcgaaattatcatccgccagaatcatggacgcggcatccttggaaacctctgttcccgtgattcccatggcaactccaatgtcggccttctttaaggcaggcgcatcgttgactccgtctcctgtcattgaaacaacatttccccgccgctgccatgcgtccacaatacggatcttgttttccggtgacaccctggcatatacggaagtctttgctatatttgagtccagttcttcatcggtcatggcgtctaattccgcgccggttaccgccatatctccatgttcaaaaattccgatctgctttgctatggcagttgcagtgatcttatggtctccggtgatcataaccggccggattcctgccattttggcatcggctacggcctcctttgactcttctctaggcgggtccaccatggaaataagcccaaggaagataaagccgttttctgagtttaaggaaagcacgtggtcctcttccacttccttgtaggcaaaggcaagcacccggagtccattttctgaaaatctcatattctgatctaggatatcctcccggtccttttccgtcagctccttaattccctctgaagtacggatgtgggtggtccggtacagcaatacatccaccgcgccctttgtcagtacggtaggaattccatggagctggtatttggtactcatcagcttccggtcagaatcaaagggaagctcttccagacgatgcatcatttccctgatgagatcatggcttaaactgattttccctgccatttcaaggagggcaaactccgtaggatctccgatcccctttccctccacaatggaggaatcattggttaagagtgcatcataaagaatataccggtgaagctgattgcgaaggtctaattcatccggctgacagacttttccatccacatagatttcctgtacggtcatcttattctgggtcagtgtaccggtcttatcggaacagatgacagaaacgcagccaaggctttctactgcctttaattccttgataatggcattttccctggccatacgctgggttcccattgcctgtacaatggttacgatggagcttaaagcctccggaatggcagcaactgcaagtgccaccgcaaacatcagggaatccaaaagaggcattttacggtaaatgcttatcaggaataccagggcgcagatcaccatgatgaccatggcaaggcggctggaaaactggtccaggctgatctgtaaaggcgttttcttctcttttgtggcattcattaagctggcgatctttccgatttccgtatccattccggttccggtgacagccacaaccgccctgccgtaagtaacaaggcttccggaataaaccatattggtccggtcagccaggggcgcttccatgtcaagagtcccttcttccttgtccacattggtggattcgccggtcagggagctttcattgacctgtaaggaataattattaagtatccttccgtcagccaccaccatatctccggcttccagaagaaggatatctcccggaaccacgccttttgagggaatctcgatcttttgaccgctgcggaccaccttggccgttggcgatgataaagattttaagcttgccagggacttttgtgctttttcatgctgcaccgttccaagaattgcatttaatacaatgaccgccacgatgacgatggtgctttccacatttcccgaaagcatggaaatgacagcggctgcgatcagaatgaccaccagcagatccttaaactgctcggcaaatacctgaagggtgctttttttcttcccttcctccaggacattttcccctttgctggcaagaagtccggcagcttcctctgtgctcaagccttcctttgatgtacgaagctcttctaatacttcctcttctgttttctgataccagtctttcaaactttcctccattctgccatcccaatgggacagcctgcatcaacaagtactgttatgaccgcttgatttattattgccctaaaagggaaaagaaaaagactttcaatgcatttattctggacaatatcaaatgttcagaataaatacattaaaagtctggtaaccattgtctggcatgcaccaccaggctgccctctggcagtcaggatgttgatgatgcattaaaactactcccttttaatgaagcatattcaattataaatcagtgactttatgtcttcgatccagacaattatacgttctaatgatacatttgtcaacaatcatttatcataattctttataaccatctttcacggccatttgctacagtattacatttaccttcatgtaatttccggaattcctttcaatatcagcgatcattgccggagcttcttccattgaaacagtcctggtcagtatctttctcacatccaccctgcccctgtggatcagctcaatggcttcttcaaactcattggcactggtgcgggctccccggatatcaatttcctttcttgtgatcagatcggtgggaagaggagtctcctttttcggccagcccgtaagggtaacacggcctgcatttgccgcaatatccagggcagaacgaactgccggattcgcgccggagcactccatgacaagctctgccatgcgcccttttgtaaattcctccactctctctgtcaggctctcttctgctgagtgaatggtatactttactcccagactccttgcaaaagaaaggcgctcctccacaacgtcaatgacaataggctcagctccataagcaagagccgacatggctgccagaagacctatgggacctgcccctatcacagccgcatgttctcctttttttaatccgcccctgtgaatgccgtgaagggcaatggtcagaggctccgccatgggtgcgatgtcccatggcatatcctccggaagcttccacagcatatctgcgggatgtaccatataatcggacattcctccctccacatggacgccgagaacctttaaaccggtacagcagttggtgcgcccgatggaacaggggtagcagtttccgcaaaaaagatagggatccacaattacatggtctcctgccttgattcctctcttgttctccgatggaatggatacgacttcccccaccacctcatggccgataatccttggataggataccagcggattggttccccggaaagctcctatatcacttccgcaaataccggcagaccgcactttaatcagagcctgcccttcctttggttccggtttttcaatatcaatacatgaaacgttccatggttcttttaaatagatcgcacgcatgtttcttttacctccatagcttatgccggcagcagccagttatcagcctcccagataggcttttttgatttcatcagaatccatcagcattttactttctcctccggcaaccaggtttcccacctccaggacataggttctgtcggatatggacatagccataaatgcattctgttctacaattacaatgggtatgtttctcaccttattcacgcggacaataacgtcaaacatatcatcaacaattaccggtgcaaggccaagactgggctcatccaacatcaaaagctctggatcagacataagccctcttgcaatggccagcatctgctgttcgcctcctgacagggaacctgctttctgctttgcccgttcctttaaccttggaaagatatcgtactgttcttccagatgccgttccatttccgcctttgacatttttttggaataggcacccatttccagattctcctgaaccgtcatattggggaaaatttcccggccctccggtacatagacgatttttttattaaccaccttatgggtagggagaccgcttatgacctggccattgtattcaatggtgccgtttctcggcttattgattcccataatggacttcataagagtagtctttcccgccccgttggctccgatgatggatacgatttccttatctccaacctcaatggatacgtcaaacagagcctgtaccttgccataatatacgtcgatcccatttaccttaagcattcccggccccccttgccatattctgtttataccggtcgcctaaatatgcctttattaccaccggatcctgctgtatttcttccggtgtgccttcggcaatcttagctccaaagttaatgacagttatgtagttgctgatgttcatgatcacatccatattatgctcgatgagaaaaatatcaatgccggaatcaaacaccttcagcatgatattcacaaactccacacgctcggaaggatttaatcctgcggcaggttcatccagaaacagcagtttcgggtccgacataagagatctggcaagctctgtaagcttctgctttccataaggcatattggacggatattcttttgccagatcctttaatccaataaactccaggatctgatccgccttttcgctcatgagcttttcttccctgtaagctcccttaatgtcaaacagaaagggaataaaaccttgcttttggtctgtcatatttcccatcatcaggttttccttcacagtcatggaacggtataattttaaattctggaacgtccggctgcagctggtccgggcaatctgatgggcgctcatgccgcttatcttcgtttcctcatggtagatttccccctctgttaagggaagaagaccggttatcatatttatggctgttgactttcctgctccatttggaccgatcaaagcatgaatggtacgttccttcatatccagagtcagatcatttaccgcaaccagtccggaaaagcgctttgttacatgattcagagttaaaatggattttccttctctcttatctgccatttacccgctctcctttccctgctctttccgttctcttctttcctctgaataacgaaacgattccatttggcataaagatgacaaacagcagcgtgatgatggaaaataccagccagtagtaattttccatgaatcttaaaaattccggtacaagagtcaccaggattgcacccagaacattgcccggcacagaaccgattcctccgatgaccagcatgacaacgtagttgatagaatattccaggttatatgcacttggattgatgaatccaatgtagtgggcataaagactgcccgcaacagtggcgtagatggcagcaagagtaaatgccaggattttaatggacgcaatgttgacgcctcctgcttccacagcatcaggattatccttaactgccaggaacgcgcgtccccatttggaattgacgatcctgtatgcgttgaagataagaatcactgctatgatgaggtagagataataaatctctttatttgtctgaaatttgtgtcccaggatggaaaaggccggaattcccgttacccccaatgcgcctccggtcagacctgttaaattggtcatcaggatgcggacgatttccgaaaagccaatggtagtaagggctaagtatactccggacacccttaaggaaggatagcccagacccattccgattaaaactcccatgccgatggccgctgtcaggcagatccatggattgatcccaagcctcgtagccagcagggaagacgtatatgctcccatggagaagataccggctgttcccagattcatctgaccggtaagaccggttatgaaattaaggcccacaacgatgatgatattgatcagcacctggatcatcagattcagatgatagttattggaaataaacatgggcagaactgccgccagaacaattgcagccactgcaatcaatgatgccgatttattgattttcatagcgttcctccttaacgtttatttcccaggatccctgatggtttaatcagcaggaatataatcaacagtacaaatgacaggcagtctttataaacagacggaatcagcatgcttccaaaaatttcgaccacacccagaagaataccgcctgcaatggctccgggaaggtaaccaaaaccgccgatgacgccggaggcaaatccttttaagccgatcatggaggacatctgcagctccacattgaatatgggaattaccagaattccgatggtggcacagataattgctgataaaccaacggtaaaggcgatgttcatgggcacattgatccccattaaggaggccgccgtcttattttccgatacacagcgcatggcttttccggttttggtcgctttaaagaaaacctgcaaactggcggtaatcagggaacagaccacaataatcaccagatgggattttgagacaaccacggaaccaaagtgaatggatcctcttaaaaaattgtccagggtaaagggaagagggccccagatcaggcggaccgactcgatcatgatcctgccaagaatcacggttccgattacagcaaataaattggtggaaagcctgcttaggggattgaaaattacaaatgcgctgacaataccaagcaaaaacatggtaaggacagtaaaaagaatcgccaataccggcggaaacccaagacccagcacataggtaccggcaaacatataagctccaaacaggataaacttatcatggctgaaattcaacagtcctgttgcattccagataagagtgtactcaatacctaccagagcatagataaaacccatagcaactccggtaatgagcagctgtacaaatacttgcatatgtaatgcctcctcatcatatacacccggcagctaaaagcagccgggtgccgttcattctctttctatatcagtttaaagacacctgcttggatacagacatattcttttccccgtcaaactccagaatataaaggttggtattcatctccccctgcccagagcagttaagcttgccgaatacagcattaaaatcctttgtttcggaaagagccttgcggatatcctccggtttatcggagccggcccgttcaatggcatcggccgttaagtaggctgcagtataatacatggctgcataacgttccacatcagctccccagcgggccttaaaatcatccagaaatttcttcatggtctcattggtctggtctgcatagaaatcagtggaagcataagtcccttccaactgttttgcgtcgcataagtcataagtctgggactgtgccagggcatttgggccaacgtgaggcagttctcccatgcccagctcgtccagctggcgcacgaccaaagccgcttccgcatcgtgggaaaagtcaaaaatcacatccggtccccagcccttgatcttggaaagctgtgaagtcaagtccttatcccctgatgtaaagccttcggaataatactcaattccatttgtttcgcaatactgctttgtggcattatcagctgccacaccgtaatcatccgtatcatagagcgctcctatctttttggcgctgaattgttccctggcaaactccaccatagccggtccaaccgatccatcggaaacggatatgcggaaaaagtatggattctgtgcgtccagaagctttggagaggttgccgcgctgatgaatggaactcctgccttccggtacaattcctgggttgctgatgccataggggaagtatgggggccaatggaaaccgaaacattctctccaagaatcttattgaccgcattcactgcacctgtgggggttcctgtgtcatcaaccaaaaccatttccaaaggcctgccgcccagcactcctccttttgcatttatttcttcaaatgccatggttacggcctgcttcatgcgaagcccgcctgccgccatagggcctgttaccatattggatactccaaccttgatcggagttccggtggcagtggatttagcccctgcctgagtttctcctgccgccgctgccttcgtggttcctgacggactgctgccgcaggcagccagggatgagacagtcataccgaccgccattgccatgcataaaacttttttcatccttctcatcttgtaatcctcctcttacacatttttatttcatttgaatgtgatctaaaatatattaatcagtatgtaatatattttatttgcatcagtatactactctcatatctaaaaagcaataataaataattttttaacaaaaactttgtatattttgtctattgtaactatttacattttatacacatcaaccatagtatctattttttacgtaattatcatctattttttatttatatttattattttcatctatggtaaaaccattaactatacagtatactatatccgttgttgtattttcttttcaagtaatatattcatcttgtgtttatagcactcatatttagagattttccgagacattgccacaatgcaaaggagcacttaaatgacaaaaaacttcactcaaaacccgggagaatccgctcgtgaatttgccctgcggtttcttctggaccagatcatcaacctggaatttgcaccaggacaaaaaatctctgacatcgagatttcaaaggaattaaacatcagccgtactccggtaagagaagccattctttcattgaccaacggccatctgatcgaaagctaccctcaaaaggggatttttatttctctgatcgattgtaatattgtagaacaggtatgcaccatgagaaggatgatagagggaccgctggcagaaatgagctgcgattttattacccaggagcacctggacaatttatatgactatataaccctccaaaaggattatgcatccaatggaccaagagaaaatttcgagaaatttctggctcttgatattgctttccacaaagaattttatgatatgtgcggaatgaactttatctatgataccatgcagaccattatgcctcactttgaccgtcaaagaaaactgagttaccagatcaatgtatcggaccgtgtcatcaatgatcataccgccatctgcaaagccattgaggaaggggataaaaagagggcttcccaggccatggtccgccatatatccacagcactggcagatcagcctatgctgaagaaacaatttcctgactatttcatttagcagatccataccatttttgtatcacaagcagccgtaagacagaatttgttttacggctgccaccatgccatccggtttccattcattccggcagttcgccggccggcacggattttgtcacaatcacatctgcatcatacccaagaatatttttcaccacaaccgttccggctgttacaggcgcagtcagactgcacctttttatctcttccatggcatcaaaaatcctgcctttggggatgggttttgtcaggcgcacactggctaagggcagaatacctccttttacaagaactgaagttgcaatattacgccggggatcggtcagttcctgccttacataagtttccccctgggacaaagagcgccgtccatagaccgtatcagaatgtttttgccttcgtttatttctatgtccgcggttatttcacatccattggggcagataatacaggtaaattccttcagcattccacacacacctccaactctgaaccggataccagcttttcatgagaaatgccaaagcggatcatttccgcaggaatggcttttttcatcttttttacggccacttcctttcctgcctggcgcacaacgatgcggcagtccttcatcggtttttttacccttaaggacaggataaattctcttgtcccgctgatccgctgaggcaccgtatacgcgatattgcaatccgttttcacagggatgacagccggattgaggctgcctttttttatgtattcggccaccgaatcagccaggctctccgcctccaaagatacaaaatcaaccagatcgtgtacatgaagaacgtttccggctgaaaatatcccgtctgccctcgtctggaaatattcgtctacacaggcccctctggtccgttcatccaggatgactcccgcatctaaggacagctcattttccggaatcaggcctacggaaagaatcagcgtatcacactggtattccttttccgtaccaggaatgggcataaaattctcatccacctgggaagcagtgacccccgtaagcctggtatttccatgaattgcggttatgccatgacttaaatacaaaggaatgccgtaatcgtttaggcactgttcaatatttcggggcagtccgctggggtaaggctgaatctcaaatactgccttcacatgggctccctccagggtaaggcgccgggccatgatcatgccgatatcgccagaccccagaattaccgcttccctggccggcatggtattaaaaagattcatataagcctgggcagcccctgccgtaaatacgcctgcaggccgttctcccggaattccgatggctcctcttgtgcgttcccggcatcccatggtcagaatcaccgcctttgccttccattgcatcatgccttccctggaagctgccgtcaccagcctgtcacgggtcacttccaacaccgttgtgtcggttatgtaaggaatatgtaactcctctatggcatctatgaaacgctgggcatattcaggcccgcttaaggcggtctgaaagcgggtcaggccaaatccgtcgtgaatgcattggcgcaggatgcctcccagctgcttttccctctcaaggatcaccaaattccggattcccttatggtaaagttccgctgctgccgcaagtcctgcaggccctccgcctataatcaccacatctgctgcctttgttgggatctcctttaactttccttccatgactccacctcctgccgcacttttccaaagaacatgtaagaaccctttctggcatattggatttgatcttctttctttccaagctcctgctccagcatctgtgcaatacgcatctgacagtaaccgccctggcagcgtcccatcatggaacgggtcctgtatttgatcccggccagggtatccactcccagcggattatagattgcctgaaggatttctgcttttgtcaccttctcacagcggcatattacctccccataatcgggattttccagaattttaaggttctgctcctctttcgatagctccgaaaaccgctggattccccttcgtatgggatgaaaggaggtgttgagttccagcttttctctctctgccataagaccgacagcatatcgggcaatggggacagcggcagtcaggcccggagattctatgcctaccaggtttatggcacggggcgccacatcatcctgtacctcaattttaaagtcctgtataacgccattctcatccacccatttaggaaggatcccggaataattgcggatataatccctcttattgatacagggccacaaatctgaagcactttctgccagataatccatattttcctgtggtaccccataatatgaaaaattctcagtcatatcagcatttggccccacgataacattgccatctgttgtattggtcacatggatccccatataggtgttgctgggaaccggatatacgggcatgggaagcaaaggaccggtccttttatccagaatgatataatctcctttggagcctatgattttataacctttgattcccaatagctccgatatttttccgcagcccaggccggcgctgttcaccacccagcggctgaaaaatttcccgcctgaggtcgtaaggacatagttgctgtccgaatccttcccaatggccctcacctcacagtcaaagaaataatccacaccattttccgaggcattctcagccagagcaatggtatagccaaaaggatccacaatcccgctggcaggagaatacatggcaaattcccccacaacagcaggcaccagttcgtgaagccgctctttgtctataagttccagtccctttactccattggcttcgccctgctttatggtctgtttcagcgcttcccggtcatcaggggtatttcctaccagcaccttgccgcagcggtgaaagggaaaatccagttcttcggaaagtcgtcccatgttttggctgccttccacgcagagccttgcctttagagaacctgtgtcatatgcaaatcctccgtgaaccactccggaattacgtccgctggtctcgcagcatacatccaggtttttttccaaaacacctattttcaagctgtatctggacatttcccttgcaattgcacttccaattaccccgccgccgataatgagtacatcatataattgtttcaatgtttttaacctcctggaaaaaatgacgattaccatgcatgtattcgtcccatgaatattcttattataatcatgcttggggaaataagtcaagaaaaatcgagaaaaaggtacatattcatcccatgaatatgtacctttttctcgatttaagttttctcttcctgatttaggcctgtgaatcagtttctttaccggccttcttccttataacggttatcgttatacatcaaatggaaattcattgcctgctgtgcctccaccggtttccggtccctgatggcttcaaatattctgcggtgtgacaggagtgtctgctcatactccgtctcccggactgaaacagcaaaaatatggaccccatccgtgatcacgggtaccagatttgccatgaccagattatggctgcagttggcaatctgggcatggaactgggaatccttctccgaataatcctcccggttttctatcatttcctccagatccagaaggatctgctccagacaccggatatcctcttccgtggcgttctgggctgccagagctgcaatcggaggttccagcatgaccctgacctgaatcagatcctccgtcagctttcttctgtcttctatcatggtaaaacccagaggatcatcggccacaccatttttatctgagagaaaggttcccgatccctgccggatggtgacaatattccgggacatcaggattctcaacgcttcacggaccgtattgcgccccacctccaggacctcagacaactccacctcagtaggcagcttgtctcctgggacataccccttttcctgtatcatctgcagcagcttttgggaggcaacttctgccagtgtctgtttttccatggtattcccctttcctatgatagaaaaaacagacagcagatggatatgaatctgtccgctgtctgccttatggcatcattattttattctgacactttttcttctttcttatcttctgccttagcagccaaatctgccggcttcatgcttaagttgattctgcccatcttgtcaacttcaatgactttaacagtcacttcatcgccgatgttgaccacatcttcaacctttgccactctcttttcagacagcttggaaatgtggatcattccatccttgttgggagccagctcaacaaaggcgccaaagttcatgatcctgacaacctttcctgtgatgacctgacctgcttcgatctctgttacaatgctctttatgatctggatcgcgcggtcgatcatagcctggtcggttccgcatacagatacacttccgtcatcagaaatgtcgatctttacgccggtctcttcgatgatcttattgatcaccttaccctgctttcctaccacatcgccgatcttctgaggatcaatggaaatctgatcgatcttcggagcatacttgccaacttccttacgcggctctgcaatggcttttgccataacctcgtcaaggatataaagtcttgcttctctggtggttcggatagcttcctcaatgatcggtcttgtaaggccgtggatcttaatatccatctggatggcagttatacccttatgggttcctcccaccttaaagtccatatcgccgaagaaatcttccagtccctgaatatcggtcagaacgatataatcgtcatccgtatctccggtaaccagaccgcaggaaatacctgcaacagccgctttaatgggaacacctgccgccattaaggacatggaggaggaacagatgcttgcctgagaggtggaaccattggactccatggtctcggaaacggtacggattgcatatgggaattcttctcctgaaggaagtacggggatcaatgccctttctgccagcgcgccatgaccgatctccctgcgtcccggtcctctggaaggccttgtctctcctacagagaaggacgggaaattgtagtggtgcatatatctctttgatgtttccatatcatcaatgccgtctaatctctggctttctgataatggagccagggtacagatatttaaaatctgggtctggccgcgggtgaacatggcggaaccatgcactcttggaagcatatcgatctctgctgccagatggcggatctgattcatggcacggccatcaggacgcttgtggtcttttaagatcatcttgcggacggtctttttctggtactggtaaatggcttctcctaatacggacagccactcttccttttctgcaaaggcttcttccagtttctgggtgatcttgcggatgttttcttctcttacctgcttttcatcggtaaatacggcaacttccatctcttccggagtgacaatttccttaatggcagcaaataactcttccggcactgcgcagctggtgtattcatgctttggccttccgcattctgctacgatggtatcaatgaatttgatgatttcctggtttacttcatgagctttgaaaatggcctcgatcatcttatcttccggaacctcattggctcctgcctcgatcatgatgactttttctcttgtggaagccaccgtaagagccatatcagatacctgcttctgagcctgggtcgggtttaccacaagttctccgtctacaaggccgatctgggtggaagcacagggaccgtcaaaaggaatatcggaaatgcaggtggcaatggcggagcctaacatagccgtcagctccgggctgcagtcctggtctacggacatgacgatgttgtctaaggtcacatcgttacggtaatcctttggaaacaggggtctcatgggacggtcaatgacacgggaagttaaaatggcgttttcagacgcttttccctctcttttgttgaagccgccgggaatctttcctacggcgtataatttttcttcatattccacgctcagggggaagaagtcgattccctcccttggcttatcagaagcagttgcagtggctaatactacggtgtcaccatagtgcatgaacgctgcgccgtttgcctgctttgctactctgccgacatcaacggtcaatgtcctgccggccagatccatactaaaactcttgtacatactggtatctcctttaattggattaataatttatattaacagtagaagacgccgaaactactgatctgcgcgcaaaaatgagtttgcttatgcagcccgtcagggagaataagcagaatctgccgcaggcagaatctgccgccgcaaactcgggacctttggtccctcgttcgcggtggctcgccaaaagccggaaacaggggatggatatgcgggcatatccttcccctgtctccaacttttggctctgcttttacgcgcacatcagcggtctcggggaatgcttctacttttaatattcttttcttaatagacagatagggtggagaagttctccaccctaaatggtttattattttctgattcccaacttctcgattaaggaacgatagccttctaagtctgtcttctttaagtaatcaagaagacctcttctctgtccaaccatcatcagaaggcctcttctggaatgatgatcttttgggttcttctgaaggtgatcagttaattctgtgattctctctgtcagaattgcgatctgtacttccggtgaacctgtgtcgccggcctttctgccgaattcagcgataatagctgctttcttttcctttgaaatcatgttgatttcctcctttagtctttaagtctcacctcataccaagcattggctggagtatccgaaataccgggtatcggcgcgtatttgtactgatacagtttaccacagggagaagtggttgtcaattatttctatttgagagcaggaacaaattatagtggcaaaaactccctctatgcctgtaatttacccataaaaatgccattttatacgtaccctaaaggctttggcttatcggttctgaccatcgtctttcaattcgtattttccatttcaactgttttcttcctgtctttttatcattctccagagagttgtcctgctgacccccagctcttccgccagatccttttttttcattctgggctgcaggccgcagcattggttaaattccgtacattggagtattgggctgagcatattctcttttttttctgcttttttaaagattttaagctgactgatatcattttccagaatgatacccgtatcattcagaaccgttaatcgctcgcagatgttgcggagctggcggacatttccgggccattcatattccgtcagcagcttaccggctccggcggaaattctgggcgccgatttaccgatttcacaggcaaagcgcagcatgtaaaaatcgaccatggtcatgatatcttcttttctttctctgagcgggggaatgataatatccagcagattcagccggtaataaagatccgaacggaaattcccttctttgatttgtttttctatatcaatattagtcgccgaaatcaccctgacatccactggaagcacccggtcactgccgatcctccttatttccttttcctgcagtacccgaagcagctttgcctggagtgcaaaaggtatttctccgatctcgtctaaaaatatggttcccttgtgggcaagttcaaaaagaccgatttttccatttctggaggcaccggaaaaggctcccgattcatatccgaacaattcgctttccagcaggttttcaggcaaagccgcacaatttaatgcgacaaagggttcatgactccttttgcttgccctgtggatgctatgggcaaaaagctccttcccggttcctgtttcccctatgatcagtacgttggaatccacgctgctgtatctttttgccatggatatgttatctttgattgcccggctgtttccgataatatcctcaaaggtatatttggaggtcaatcctttttcgcttagcccccggcgtattttggtttctgtttccatgattttctgggcattctgggtaatgatcatggttccggcactatgattatccaccataatgggtttgtactgaataaaataattttttccgtttatcttcatcagctctgaagtttctttttctgactccatggcctgctgccactttaactctttatgaatgaccttcagaggattgttgatgtaatggtcctgggtggacagctggtaggcaatataggcctggttgttgatcgcaagaattctccccgcttcattgaccgctatgatggcatcttcactgctgtttaggatcatgcgcatcatatcggctttggccctttcattattaatggttcttgctgcatttacagcttctaaaagcgcctgctcaattgccatgtcttttgtttcaatatgaattctcggtattccgcttttgtcacacagtccgcagatcgttcctgctcccaccaccacatcaattcctttgattttcaggtctttgatggcctgtttgcagctttcctcatccgaaatgtcgtaaaattcgatccctgcaccacacagcacctccagattctttacagaggcaaattcctgcttctgaaggcatagggcgatcctgtgcggtgcgaaggtttctttgcatcttacaagagcatccacaatatcaaagctggttaagcgaagctctacgatatgcttctttgggaacagctttttcaacctgtcataagtcattcccctggccaccataatttctgcgtccttgtttttggaaagagaatccggcgttccaaaaacatgaatcagctccattctgatgtcttctcctttgggactcaattttgaaacagccctctcaaatcgttctctcatgttattacggggcataaatatcagaatttttaccatacgaacatccatcctttgcaaaaagcatccaacaattttactgatattgtaacacagtcagatgctcttttgcattgaaatcatgaatacccggctggaagttatatcctggccggattttatttatttactacattctgcggggtgcctgcatgatatgcccttaaattgtccaccgcgatatccatcagtctttgtctggattcttttggcgcccaggctatatgaggggtgatcaggcagttttttgcacttagcagcggattatccattttaatcggctcggtggatactacatccaccgcagctccggccacctttccgcagtttaatgcatcacgtaaatcctcctccacaatcagcggccctctggaatcatttataattatgactccatctttcatctttgcaatgttttctttgtttataatcccttctgtggaaggaaacagcggacaatgaagcgcaatgacatcagaatccgccagaacttcatccagtgatgcatagcggcacgtctctgcttccagtgccctattctgatattcgtcaaatgcaagtaccttcattcccagagcctgggctatttttgcggttctctgcccgattcttccaaatccaataatacccattgtttttccggcaagctcaatgagcggatggttccagaaacaccagtcctgattattggtccaatcccctcttttcacgcattgggaatgctccccaatgtgatggcacagctccagcaaaagtgcaatggtatactgggcaactgcatccgtcccataagtgggaatattggaaacagggattcctgcctcccttgcagctccaacatccaccacattgtatccggtagccagcaccccgataaacttaaggttagggcaggacgcaatggtctcttttgtaatgggtgttttattggtataaactacttctgcatcgccgattcgttccacgatctcagaagcaggagtcctgtcgtatacggtcaaacttccaaattcctcaaatccttcccatgataaatctccaggattttctgtgtatccatccaaaatcactattttcatctttccagcctcccttatcaatcttctaccagcgcccaggcccggttaatgacacgttttgtattggccaggataatatccccgtcttcctctccccacggcttaacttccagggaaagaacgtatggattttccttttgaaaaaaaccttcctcctttaaaacagtaaagaaatcccttaattcttccacatcattggcactgtccggatatccgaatctgggatgctggtctccataggcctcacagcccttctttactactgcattgccaatatggaaatgggtaatataagggcgaagggtctgtacggcaaatttactggtttcatacgttgttggaaaatgggaaagatccaccagaaggccgaagttgtgattggtcatgcgcatatccgccgcaaatctggctgcataaggagccggaccgatcaatgctgctttatccatatcataatcaaatacttccagttcgatcatcattcctttgcctgccgcataattgcaaagatttctggttgtttttaaaagctgtgcatatgcctgctcctttgtttcctcctcccattttcctgccagaaacgcgactccctttgctcccatgtattccgcttcatccaccgcctccatcagcgttgcttccgccttcattcttccctcttcattaatgtcattgggattcagtttcggtccaagcagtcttggctgagccccatagcagacctttagatgagactgctccagcatgctttttactttgactcttgttgcgtcgtcttttatttgcgtaatttcaaatgcactgaaatattcgtcacatgcaatggtctttacagaatccactatattataggaaaccggtggatgagtcatccactgtatggttcctatctgaaaatatttctgaattgggtctttcatctttttttacctccatctcttccccgccatggggtatgttcctgtcctgttttctgaaactgattatatcatatcccatgctagattcagagtcctttttgcatttgcgatcaccacttcactgtcttcctctttccacggtttcacttcaaagcttacaatcggcctgctctgtttgcttaaaaaaccgatctccagtaagacctttaagtaatgggccagttccttcacatcattttcgctgtccgggaaaccgaaccttgggtgctgatctccataggccggtaaggaaggctttcggatcacggtatttcccatatgggcatgcttaatatagggtgcaacaggcatcagattctcttcaaacgtttcgtgaagcatggggatatggctgcaatccaccagaagaccaaaattatcaaattctgaggtcatgatctctgcatactcttttacaagcttaaccggtcccatcagggatctcttatcaatgtcatagtcaaatacttccagagtgaccggcatatctccctttgcctttgcatagcggcaaagctctccggaactctttaaaagagcttccagggactgcctcctggtggctttctcgtaattcccggcaaggaaggaaaaacctgcagcccccatttcgtaagcctcatcaattccttcctttaaggaagcaagtgccgcaagcctcttttcctcatccagatggttgatgtttccgccggtagtcagcatccttggctgtcctccgtaagcaacttccatatggccgcaccgaatcatatcagccgcctgctttcttacctcctgatcccggatccaggtcacttccactgcctcaaaatactcatcggtcacaatctttttcaaacattccagtatggggccttctccggaagccaacccacggaaagccatatgtaaaatgataccgaccttcatatattttctcatcgattcattcattccccatcacttccttgccatcaccttcctgcatgctgcaccaatcgcctgactgctgtatccgtatttttccagaagctgtccgtaatccccggattctgcaaattcctctgctccaatcatttccaacggagcaggatattcctgtaccaatacctctgcaaccgcacttcccagtccgccatggatgctgtgctcctctacagtcactatggctccggtttttcttgcaaaagcagttatcagctccctgtcaaccggcttaacggtatgcatatcaatcacagctgcctcaattccttcctcccttaacagctttgctgcttccagggcttggtgcagtaccgtacccgttgcaatgatggtaacatccgttccttcctttaagacaattcccttcccgatttcaaacttcaaagtttcatcataaatgacaggagcaggcgctctgcttaaacgaagatacacaggtccctcatattccgccagcgcaaataccgctttttccgtttccaccccatcggatacgcttaccacggcaaccccaggaatggctcttacaaatgccatatccgtgatactgtgatggcttgctccatcataggagtcagacagtccgcagtaggttcctgccagttttacattcagcctgtcataagcgatgaggctctggatgggatctgctcctctggttgttaaaaaacttgcaaatgtattgacaaacggaacgaatccttccagggcaaagcctgccgccatggcagtcatattcatctcgctgatccccacattaaaataacggtccggaaactcatttccaaaaacggcgctttttgtggatgccccaacatcagcctccagtgcaattattttttcatttctctgtcccagcttttttaaagcttctccatatgcatcccgaatcgcaacctttttcatgccggtgtacctcccagatcaatctttgctgccttataatcctcttctccaatgggttttccatgccagatattcttcccttccatgaaagagactccctttcctttcaccgtatctgctataataatgacaggttttcccttacaggccacggccttgtccagggcatcggaaatggactttacatcatgtccgtcacaggtcagtacattccagccaaatgccgcccactttgcagaaatatcgcccattggcatgacttcttccagtgttccgtcaagctggaccccattattatccagaacggcaatcagatggtccgcctggaatttggaggctgccagggcagcttcccagacagagccttcctggatctctccatctccaagtacaacgtaggtataagcttcgctgccctttaaccgttctgaaagactcattcccaggcctgcccccagcccaagtccaagggggccggtggacaattcaactcctggtgttttatgtaaacacgggtgcccctggagattgctgttaatctgccgaagggtctttaattcctcctttggaaaatatcccagttctgcaaggatgatgtagagaatgggagccgcgtggcctttggaaaggatcagccggtctcttccctccatatccggctgcctgggatcctgcctgattttttcataatacagcgttgtcagtatttcggtacaggataaagatccgcctggatgaccggtctgtatgtggtaaagcagatcaatcagctggttgcggaatcttaaacataagcgttgtaattcctgctgtctttcagcattcatattgttacactccttttgcttttaaatattcatttacctgtctgatacataaggcagggctggataaggttacaattttgcagatatcttcaatatccttctgaagatgtgccatagaggcctgggcaagaattacacagtcataattttggatttttcctgcctcttcccttaaaatgctgtcgtgaacattcatttccagttccttcatagcgcgaaatgcctctttacagacgatctgatctaagtcaatttctacacccgccgcggcagcttcttttttaagcttctccctggtgggttcaaccgtactctctgccgttgccataatgaggattctcctgccgtaagttatcccctttgcagccatggcatcatcaatggcgattaccggcacctttataaacggccggagcatatccacaaccggtgtcaaggttgagcaggtggtaacgataagatccgcaccggtcatttcctgagcctttaaatccagaaacaggcggtttctgttatttatggtaaattcaccaacttcattgggatgatcggccagataatcatccagcagattataaactctgatcgtttcttccactccgtccctaagcgcctcttcaaatgtttttgccacattttttaccgtatggatcaatgccactgtcttcatatccgtttttccctctttctatgtcccatacaccttgttcaggatcggttttaaatacatggccgccctctttgccgcctcatactgactgggtatctgataaatttccgtacagaaattccctttatagccgcattctttgaaggtatgaatgattttttcaaaatccagtccgcattggcccggataccttcggttattatctgccagatgcacatggatgttataagaactgtatctgcggatggcttcacagatatctttctcttccaggttcaaatggaacacatccatcatcagcttaaaattcccccggttcacccggtctgccagccttgcaccttcttccagagtattaataaaattggtctgcatgatggtaaccgtttccagagctattttaacgtcccttggcttcgcatactctgaaagctcctgaaatgccttgacagccagctcttccgtctcatccctggacagctccctggaatactggcctctgacacgtccaatatttatatccgctcccagaaaacaggcaaaatcaataatttccctggagcgcctgatggcttctgcccgtatttccgccctgggatccgtatagcttaacccaagctggccgaatatctctccggtacaaacaagaactattgacaatcggttcttcctggcttctgcttttacctcctcccagtcaagccgggacggatcgagagtcataagctcaaccccatcatagccaagaccggcaagagcctgaaagctttctgaaagtgatccctgataagcggttaccgaatctgctgctgctacatccggagtcgctacctgatagcatagtttcatgatatttcctcctgatccgctattttatcccattagccgccatgaagtccgcctcgtatctggctacatattctgctgctgccgccatatctttataatcagcaatcaatttattcttctccagataatccgtcttccacttatccgtctgggcaacctttcccagtaaatcgctccagtaagcagcggcagcgtcactcatggccgccggagccgccacaccgcgccacacaggaatctccacattcttatagtcaccgatctcacttaaggtaggagcatctgccagattaccggaataacgttcctcagccaaagccagaaccgggatcagggaacctgcctccacatactccgaggctgccgcaggcttggatatcacgaattctatatggcctccaagaatcgccgtaatggcatcaccggtggaatcataggtaatataactcatcagatcctgggtaagcccgatttcagtaagcatggcttcataggttgcgatgtcgtcgccctttgaaccgcctatcactaccttagtcccattctttgcagcttcgattgcctgggaaaaatcctggtactttgttttttctcctttaaaaatcaactgcttgtcaactgccataattgcaagaatcctgaaatttttcgaacggttggccgtattttgtatcattggcatcagatctccgctgttaaaggtcaaaagggtataatccgctttctttccttttgtgttggccacctcatttcttccgatctcaccgcctccgtccgttttatttgtgaccaagatggtttgatccagcattttttcacttaccatgatatcggaaatcatacgggtataaatatcacttccgcctcccggcttgcttgttacaacccatgatacgttttcctttggagcaaacggaccgtctgccgcctgattgctgttacatcctcctgtaatcaaagcggctgcaatcatccctgctgctaaaaatatcttccttcttttcattgtaaactcctccgttttattttattttaaggcttttcctgccatcttgtttttcatcattgatttgacggcaggggctgccactacacccaaaaacacaaccataagtacacaggtgatgggccttgtaaagaagatatccagacttcctccggatatgataaatgctttacgcatatttgattccagaagcggcgccaatacaaaggacagcagcatgggcgctgtgggataatcattcttatttaacagataccctgtaatgccggacaaaaacatgatcagaaccccatacatggaataactggaactatatgagcccacaacacagacaacggtaatgcacggaatcatgtatttcaccggtacggacagtattttaagcagaaacgggatcacacagaccgcgattgccagtgtcagaatgtttgataaaaacagagaggcaatcagtccccacgtaaaatccggttcatttgtaaataacaggggcccaggattcaatccccacatcatcagtcctcccagcagtacagctccggttcccgatccggggattccaagagcaagaagcggagcaaacgcccctgctgccgctgcattattggcagcttcacaggacgcaattccttcaatggctccggttccaagttcttcttcgctcttcatcttcttctggaccgcatatcccataaaagaacctgttgttgcacccgcccctggaagcacccctataaatgtgccgagaaatccggaacgcagagccggaggaagcagacgtctgaaatcatgcctggtgatcatgctgccccgaatggtcaatttcatatcagaagccgccccatcctttccctggtcacgctccatgataagcttaataacctgtgaaaatccaacagctccaatgatataaggagtaaacggaatgcctccaagcaaatacatgtttccaaaatcatacctgggaacacctgacaacgtatccatgccaatgcttgccagtataatcccgaacatggtaatgaccacaccctttgtaggattttcccccacaagccagctgatggaggtcatggcaatcaaaagaagagccgtcatttcagagggaccgaatttcaagcccagatttgccaaggctggaccggtaaatgtgagtatgcagataccgatggttcctccgataaaggaggataaatcggcagtcataagcgcctgccccggcctttttttctttgaagccattggatagccatccaaggccgtcatgattgccggtgaatctcccggaatgtttaaaaggattgcactgaagctgccgccatacatattggaataatacagggcacccagcataatgatcgcagttgtgggattgaacttataggtcaatggcaataaaagagccacccctgcaaggctgccgattcccggcattgctcctacaatgaggcccaatactgctcctatcagtgccgctcccacattttggaacgtaagggccgtctgaaaaccatgaagtaaaagttgtaaattctgcatctttgtttttccccctttataaaatgtattccatcagacccaggggaaattgaatccccagccacaaaccaaatactccgatcacaataaaagcgaccacagccagaataatcagtgtatccttccagcttgctttttcaaagactttcagccataaaataatataaagaaagcagctccccacaagccctataagaaaggttgcaagaataattcctgctcctgatgcgatgaccagtaattcctgcttttcgtatttcactgtcccatcttctttgaaagactggataaaagcaagtatactggttaaaaacataacaaccgccatgattgacggaaaaaaccctggtgccggcccctgagcaggcttccagaagcccagtttaaaaacgcccacccatccgaaaacaacggcaaatcctgccataaacaacggtatcatctgttttgtgcgaaccctcttcattgtaataaccctccccaaaatattaatccatatttttgatcgtccttgccatctttgcggccatcttcacagcattttcaaacgcagacgtctttgccactccttttcccgcaatatcgtaagcagtaccgtgggcacaggtaacaataggtgccggaagcccgcctgcaatagtgattccctgatcaaatccttttaatttcagtgcaatctgtccctgatcgtgatacatggtaacaaccccgtcaaattctccgttaaatgcattgataaaaagtatatccgatgaaaatggccctcttgcatcaattcccatccgtgttgcttcctcaatggccggagtgattacgtcaatttcttctcttccgcacttccctccttccccgcagtgggggttcaatgctgcaatgccgagaaccggtttttcaatgccggaatttttcaaagtagtgtttgcaagagtgattgctctcataatggtttccacgcttaagtgatcacttaccctggcaatggggatatggctggtggttcttgttgtccacaaatcccccagaacattgatctcaccaaagggagccgtctgatggaataaatcggccagataatgatgttcactttcctttgtgcagcctgccttgatcatggactgcttattcagcggcccgaaacaaaagccgtctattttgccggcctgaaacagttccactcccagcttcagcagctcaagacatgctttcccgctttcaatgctaagctttccatattcgatttccgatggatccaaattcttctggtccaggaccggaatcccgtcttcccacgttgcttccgaaacatcggatattgcctgtaccttaatattcaggccattcattttttccgctttttttaaaacccttagatctcccataatcaggggcctgcagtgctgatttaaaaaaccgtttgcagccagtcttgcaatcatttcaggccccacccctgcggcatctccaagtaaaattcccagtacaggtttcctgctcatatacttatttctccttctttgtaattcttaaaagaaaacgtcgacgtattttctatactctttaataaagcaagtatcatgccaactatggagcggtagcctttttattcataactttattaaattaccagtatttttgtgccttttttctatcattgggatcctgtgtccgctttctacatgagattattacgtttcccgatgaaacattttgaaacatatgtttttaaaatgtttcaaatctttttcctgcagcctgagattcagaacaggaaagaaccattaaaatggaaaaattacaataaaaatagtcttccatgaatttaatcacagaagacttttctgttaacccttagccgccaagccgccacaaggacagcccttttgcaccttctctctctaaaatgccgtaccaaaaattcagagtttcgtcatcggcataccaaacctcatgctcccggcctttggtgtcccaataagaataaaccctgcagccgcttttttcttcccgccgtatatccttatcccctgcctggctttgccttaagacagcttcttccgttgaaatctgctctgcttctccggtggcttttataaaatcaaatccgccgtttgctaccgcaaagtaagtttctcccggcacagcctttcctttctccaccatggaaatcaaaaaactttcatctgcctttggccctggctcagtaccatagccgtataaattataacacataaaaacgtattccggcccttttacaaagcccagttcttccactggcgccccgggttctaaaatcactctaagcttcagttttttctcagaagtctttccatacagctcattgacaaaagaagtgaacagcctccaaagctccatatcctttttcatcgcttcatagtcgatttctaccccgtcaaaacctccctgttctgtcatctccagaatatctctcatatgctcttccctggattcctttgaggacaaaagataataaagtaagtctctgtctttaagagaagagcccccttcttttttcaataagtcatttacaaaagtcaaatagctgtccatctttccgtttttaccgctattctctacagccgccttcatatccatgacgttttctggaagaaacagctttttttcgctgtcaaaatatgcggcaaaatagctgatcccagccacctcttcctttaagccttccagcctttttaatacttctttattatcccagtagactgcccagacatggaccttccggcttacggcacttacaccgttcccttggcttcccacaaaaccagaagcctcttgctgcatttcgccctctacatgcatctcctttttccttcctgcacatcctgcaagaatcagcatacagccaaaaaggaaaagaaataccacgaagcgagctttattacaatgctttgataaaccagttgataacccggttccaggtttccctaatttcataaaatgcccgttcccctctttcaatcgattatcataaagaatattcccgctgctgtccctgatcacaaggttctcaaaaacaccatcgtaaacatcatctgcaatgtttctctggctgtagccaaagttttcaaatgccgactccaggcaaagggcacctgcctccacattggatacagacagatctgataccgcatttcttccatcaatattaacggaaagatggctgccctttaaaacgatatcaagcttccggctccctgtctcattgatttggtaatccggaacataatccctgtccggcaaatcagattcctccttctgccttatttcctcctctaccttttctataggatagcttagctggctgttctttttgtacaaggtatccgctccctttaaagcttccagttcatcttccctgactgttttaaatacctttccatcaaattctgccagatttatttcacagatacttgaaccattgtcgtacacagacagcacattattcttcacttcaacgattacagccttttccggagcatctcctgttctcagccagatcctctgtattcccaatatgtttcctgtgaaatcagcggaaagggaaagatcccggaaggtcctgcttccttccagacgcaaaaggccatttccttccggctcagaagtcaaaatgatctgactgtctctaaattccacggctcccttaagaatctcccaatcagcttttcttttttcatccccctcttcaaaaatcatatccttgcctgtgtcagccttaattctcattaacagatgattcggataccagtaagcctgaggctgcagcctggtcaaatcataggggttggtctctctgttatttttagaatctccctctctgttaaaattcatggaaaacagctctttgatccatttttcatttacctcgctgactttctcatgatttccaaaccttcctgtattggcatgcatcagaacataaagatccggaagctctcccaattcctttgtatacaaattcttcatcaactgataatccttactgatccgttccttcatctgttccggggtctcctttggaatggcttcctcatcacggatataatccattaaatactgattgtaatttcttcccagatactgactcatataattgaactcctgtaggttcaattctcccagatagtgatcatacctgtcaaatacgttgatataagacaggcggtagccattggttccccattcccagaagctggatttttttagtttttttaaatcctcaggcattaaaaaggcgtcatccttgccttctaatttctgaccgtagctcaatattgtagcaaggtaattgtacttctccaatattttagcagaatagacagccgtatcccgccttccgtcttcaaacatcaggaacagggaattttcaggcaaaggaatatctttttcatagtattccatcatgtctttctgcgatatcgtcacatatccgttccgctttaaggcattcatatgttcttccagtctttgagtgctgattaaagacgaagttccggcccgatccactccaaaataagacaacgcaatgaaacccggatctccctgttttaaaccatctccctcctgaaaaggaatatacttttcaactacgaaaaaagcacggaataaaagtacaagaagagcggccagaatgatggcctgtatgacactccgcactgcttttctctgatcctttgataatctaagcaccttcataagactcctttagttcaatccgccggccttcgctctgcttttttccgtttcgttcccctcttcttttcatctttcctgcgctcctcatctacatccctttgagtcattctggtaccccatgtggatttccagaaagtaacccaggccaccggcatctgccaaagtaaaacagcttcatagtacagacagaagaccaggccaaaaatccaggtagtgctcctgcgcagcagcatctgggccatactcatgagaaacgccatcagcagaagacctaccagaaatgtggtaggaaatacatggcgggtgaccggaacataaaccagattatacaaaacaacaacaggtgccaaaacaggcacaagcaggcctatgtaaaagagtacggcggcgaatggttcctttttaaacataaagcttcctgcaattaatgattccctcagccacgagcgtttccatctcatctgctgttttaaaaagaccgggtatttgttcggcactatggtctggcagactgcactgtcctgataagaagtcctgtggtgtcttaaaacaaagttggtcatagcccggtcatctccaaaggttgctttctggcctaaaaagctttgattcagccatcgttccatattgtccatgacaatctgctttttatagcaggccaaagggcccgacaagcaggtaactacgtcaaaataagcttccgccgctttcaaaatccgaaaggcgatataatatctgacagactgcatctttgtcaggccattggtataggtatttgctacatccgtcctgccggacacccctcccattttaggatccttaaacggctgtaccaggttcctgatggcaaaaggatctaagaaactgtctgaatccacaaacaccaaaagctcatgttttgcctccagagcacctgctgccagggcttcccttttccctgagtttttctttaatacaatatatttcagcctggatctggtttcaaactgctccccctcccggtagagcttttggacgatctcatctattttttccacagacttatcgctggagcagtcatcaatgataataacttccagcttatccacaggataatcctggttgatacaactaagaatggttctttgaatccactcctcctcattaaaacagggaatcagcaccgtcactcccggcgtaaaatcaacatcaaggggcacctccctgtacaatgccccaaacagataacggctgagtaaaaatacagcagccataatgctgtacaaatacagtattttattaaatctgaaataaattacgctttccgcacgcatcaggatcacaaaaatactgataaaaaacaacagcatgctggatatcatcagcatatacctgccctttttctttgcggaataaagggacaggggaatgcaaaagagaaatccacagtggtaagaggaatcctccatcagctgggtcctggcaatggaagcctggattttaaccttcatttccagtccttccggcaaggttcctggaggatttcaaatttcagcaggattttatccgctttcttcaatacctccagagtttcctcagaagatatattcaataaaatccctgtcatggaaatgtccacgcctttgcacaccatgcttttcttctttttcccggaaacgcagatcacttccacatcataatcaaccttgtaccttaatcctgactgtttctgtgcaatatactcattaatattgctgctgtcgtaagtttttcccctcctgtctgcattggtcctgacattggtcttatccggaacattggacagcagccttctgtcctcttttaacttcagaagaacatcctctgaaatctgtccttttccttttttattgcggcgaagattcatcttgtttttcatccctattcaattcactggcagttgctttcctggtttctcctacagcggcctcagcaggtgtagcccttttctccaatggtttcgttaaataattacttattttgtcaaaccggtaaccctgatttatcaattcagggataacaaggtccaacgccttggctgtaatatccggatcagaggaaggctcattggaatcatcagacatatgcagaaccattacacttccattttgcagagggtatctggatccgtcacctttccgtattccctttaacagctcatcggccagctctctggacgtcttcgcttcataatcatgactgctgaagtcgccgcttactatgtattcgaatcccatatcaaatatagattccatgccgtttttactcatagccagggtcggcggccggaatatttttgtcagtgcaggcctgccgtctgctgccatgtctcccacaacggagcaaagctttctataggacagggctaaatccgccatcctttctgcctcaacctggctggttaaagagttataaaacggcctcttttcccgcctggatttgatctcatcgtaaacagcataaggaagatggccatctgtatgggttccgatatcgtggccttctgcagcaatggcccttaagagattggggttttcctctatacggttggtccttatgtggaagcttgccttgaccccatattttctcagcacatataaaatctggttgaccggcttatcagacccccagtcatcaatggtcaaaaacagcaccttttcgtttgtaaaccttccggttatatcaatcagcttcagttccccctgggaaaatccgggaagtacgttctcgtcgctgtaatcaggatttcccacataccgctccttcatgatcccaaacttttccccttccgagaaccaggccaaatgccccggagcaatatcccccaccccggccgtataatcagcttcttttacagggtactgataaagcccagggctgttccttaattgccctgcactgacaatgcggtactgggatccgttgttttctattccatcttcataggagttggtcagaacacggttcttataaacatccaaaagcagattcccaatgagatctttgtctttgtaataatccatccgaaaatatactatatatcctcttcttgcagatatattcccggcattaaaggaatttgccaagacagtttccaaggtcccatctggtcctgctttggaatttgccatagaaagatcctgccataccagagtgcagcctgcacttgcaatcgcttctgacatctcaccggtaatctctgcgtcataaggatatctggctaaaacaggctgtactccaaattccttgttcaatttttcctgcattccagtaagactctggtatacagacttaaagtcatttccgcttcttcccgtaaggcagagtccgatttcgtgcccccggcccaatatctgtctgatctcttccttattttgatcaatctcctcaccggtcacaaaaaatgtaccttttccctgaatctggtccatcttgtcaaggacatcatacagaacctctgtccggctgatcccggaaaaagtaaaagaaagctcctggctggtgctatgtacagtatagacagattccgcctgtctgccctgattgtcccgccggatcttatcaaaatcaatggagacggctgcttccccggaaggtgccggtgcaggagtattggatgtatattgtgttttatctatcatttcctgcagaaaagaaaccctgtaattctttttgtccagatatgccagcacgtattctgctgcttcctccacatcatcactgacatccagccttaagtggacaatttcccccttactgattcctttcttgaaatatgtttttatctcctctgccgatcttccttctgtcattgggtttttggaataagtaaccagatcataagaaagggctgaggcggcttcccgcaccaaatcgttatactttgcgtaaacaggcataaagagctttgtatcaaccccgtatttctcctttaacagcttgtcagttttgtatatttcaaaacatatactggaaaaatccatatcagataaatcttttccggtcagacctccgtttccaatctcatggccctgggcaatgatttcttttaccctgtcttcacattcttccagttcctttcctgtaataaagaacgtagcctttctattgttttcttttaaaagcagcaaaatcttttctaaattttcctggctgcctattcccctgaaagtaaggcctacatcgccgtcccggccgcccatggaataaatctcagaaagcttccccccgtttttctcccttaactgagaaaaatccatggcaaagtcctcatcctgatattggggaatctcctgtgcaaacgcagtttgatacccggtttctttcaaagcctttgtaaaccagtctatcacctgaatcaggcgttctttctctgatttattgtctttctctctttcttcactctcgttgaaagaatgatccccgtcttcctgtgtggagatttcctccactttcttaccgtactccgcctcattgagaatccctgacatcttaatggtaactatgctcccccactttaggcccttcacgtaatccaaagcctgctcatagctggaaaaactctgataattaagaaatttcctgctctcaaccacatattcatatccacaggcagaggccgcctctaaaaactcctttgagctattaggaagggtcccctgcaggacctttggtctctctcccgtaatctggtgcaggatgtggtttgcttttgcaaggttttcaattagtttctcctggggcagtttttccagttctttctctccttttaatccgctgctgccgatttcgttccctttttcttttattttaaggataaagtccgtatcctcggcagccgttattcctgatatcataaaagtggccttctgaccgttttcagacagcaattttaaagctttatcattggttttactatcgcttgtacctaaaaagttaatggcaaccacctttttcatggtatccacatccgtcgctattctggcttcctgatcttcattcttcaattggtccaaagcaccttttatatcctgggaagcgtcatataaagcctgtcctgtagaaaagctgcctgcctccattggctttaactttgccccggcaatggctacgacagaagtaaaagagagcaaaagcgcggttattttcaaatatcctccataccggcccaaaccgcttatcttcctgggtgtttttatagagtccactggtggaaccagtgcttcttcttcgacagataaaatctccattaattcttttgttatggcactgaccttatcctctttgatcacctctggaattccaccatgttcccttgtttttggagaaacaggtgcttcttcaccctgaacggcttcttccagaagaacacgaatcagcaattgatattcactcaccatatcgtaatcgccgctgtcgcagagaatggacaatttctctgcatctgagagcacttcctgcattctcacgttaatatcttcactatgagtatggtaaataaattcattataatcggcacaatcaaaataacgctcaaaaccggcaaggagcacttctcctccatgtctgcggatccatgctacaagatttgaaacacaagtataaagaaattccagcctgctgagattttttatattggaagcgaccatcggtgcatccaaaggaatcatgcgggaatacttttttgtcaggttttccatttcctgagaaagttccatgacgcattccctgatcaagtctttcccagtcataatttcatgggtgtgacagcgtaaacggaaactggacaattccttttcgttcagcagatattcctcaatatctgctgcatgaagagcataggaaaagcgaagatcaagcatggcagactcaagcagttccgcatccgccattccaaggagttctttcaaaaccaaagcaccaaccataacttttacagattcatttgggccggatgcctttctgccgtaaagtggtgagaatatacgttcatcaatgatgggaaacaagcgctccgcaaaatccttggcccatgacttttccaatatttcctttttgcgttctgtcatcttgaactgaacatcatcaacattcatccttcgctcacctcttttcatttaatccgatatcacagactgattctttttctaaagactccaataataataacctgattctcgcagctgttttccattaaaaatgcttttcacatcaatgacaacttttcccgaatcaggaaaatccccaaacagacttcctaattgttctgaattgatttctaaaaactccttatgagaaacagcaaatacaaccccatctgctccctttacttcctccatctttacaacatgtatcccataatctttttcttcctgctccccaagataaggatccaccacttttactgagatctcataggatttcaacctttccacaatatccagaactttcgaattcctgatatccgggcagttttccttaaaggtaaaaccaaagatatatacagaagcattccttaccagcttattggctttgatcagctgttttacggtcatatccgctatatattctcccatgctgtcgttgatctttcttccggacaaaatgatctgagaatgatatccaagactctcagcctgataaataaaataataagggtctatcccgatgcagtgaccgccaaccaatcccggcgtaaatcccaaagcattccacttcgtgttcatggcctccagcacttccttggtgctgatctccattttatcaaaaacaacggccaattcattcataaaagcaatattgatatctctctgtgcattctccactaatttggcagcttccgcaacctttatgcttcccgcacggtaaacacccgcttcaatgatcagttcgtagatccgggcaatctcttccagggtttcttcatctatccctgatacaattttaacaatattacttaaaacatgcactttatccccagggttaatccgttccggagagtatccaaccttaaaatccttgccgcaggtcagccctgacacctcttccagtatgggaacacaaatatcctctgtaactcctggataaacagtggattcaaatactacaatgcttccctttgttaaatttctcccgacaatccggcaagcgcttgatacaggttctaaatcaggcgttttatccttatggatgggagtgggaactgccaccacaagaaatttagcttccttaagccttttctcatctactgtaaattctatatccagattcttaatgtcttcccctacttcatttgtgacatcgattccccgcaaataggcctctatcttttttgagttggtatcaaagccaatggttttaacctttttggaaaatgctgcagcaataggaagtcccacataccccagcccaatgactgctatggtttctttcttattgatgattctatcgtatagcgtcatactgcctcccctacttaataaagcaccttgcagtaagctgcacaaaagcagatctcaagggatcaaattactgttcataacaacactctgatagatgtactatatcaccctatacccctttgcgcaataaatatttccctgcttatccaggccaggataaacccaaatattccacttatttccattattacttttattcaagttattcctatgtttgaagaattcaactttaacaattggggatagttacgattacaccaggctatcataatattcatgttcgcctgcaaattaaggaagcgttatagattaattagaaatattaaaaatactttacaagatcaatacgatatagaagaagagaaaaatcataaaaccatatataccgggctctttgaaggaagaacgctgggtaattatatttgtgagactgcaattttatcggcagatcatatcagcagtacagtgcaggccagtctgaatggatggacaccatttaaactggcctggctgcgaaattcacttatcagggtttttacatataaattccaaaatccgtttttttcatcttttgggaaagatccttcctgatttcccccatatccgcctttacaagcgtcttttctttcaccacacattctcctgccacgtacacctcttccacattggaagaattggcgctgtaaacaagggctgaatagggattatagacagggaacatattgacggagcgtgtttcaaccaaaaccaggtccgcctgttttcccggctctaaggagcctgttaagtcataaagcccaagggcttttgctccctgtgccgtggccattgccacaatggtttccgccggaaatgcgctccggtcttttgtctcatttttatgaaaatcagcgcaaagcttcatttgtgtaaaaatatccagggtgttcccgctggcaggtccatccgtcccaaggccaacaggaattcccatgagaagcatagaacttacgggagcaactccctttgctgcctttgtattggagccgatgcagtgagccactcttgcccctctttccttaaaaagcagaaggtcttcccccgtcatatggatgcagtgagctgccagggtctcttttcccaataccttaattctgtctaaatactgaaccggagacatattatatttcttccggaaaaagtccatttcataatccatctcagccgtatgaagggtaaagggaacctttaaagttgaatcaagacggtaagcctccgaaagcagttctcccccgcaggtattggtcccgtggggtgcaatgcaggccgatatccggggatgggattgatatttttttatcaatccctctccataagccagcgcttcataaggatcggcaaaatcacaggccccctcttccatcaccgtctgtcctgcgaatcctctcatccccatctcatccatggcctttgcggcttctgcctcaaagtaatacatatcaagggccgtggtcacgcctccaagaagcatctcccctgccccatagcgggtagacagataaacaagctcctcatccatggccttttgctccatgggaagcaggaatacccggagcctgtccttacaatcatccccaagccccctgaaagggatcatccccatatgggtatggagattcaccattccaggcatcagaatgccgttccttccatccacggtttttgtgtcagaaagccctgcctcttccggcaaatccttcatatctcccactgcagtgatgcggtcgttttcaaacatcacaaaaccgggatcatggatttcccggtgttcattcattgttaacacagttacatttatgattatcgttttcacactgatcaacctttatcttgttattgcccatgatttgaggacataaggaatatccctaaggctcctgcttttccaccaaaggaaccttttcctttgtcttcacatcaaacaggcccttatcacttatctttaactccggtgataccaggagcgtcaaagtggaaatggacatgatgacattgctgttcacatatcccattgcttcgatttccgctctcacctctgccagttcctctgaaagctttaaaaggcttccgtcagagataatcccgcctacgggaagtgcagcagaggccgtgattttgccttccctggctgttacatatccgccctgcatatggaccacccggttttgggcaagcaccatgtcctttgcagaatttccaaggaccagcagattatggctgtcgtggctccatgtagttgctatcgctccgggagactttaaggcatgttccacaagcccataggatacatctcctgtctttccataacgctcaaataccaccgccaggcaaagacctgcctcctgccagcatatgcttttgttgcgaatgggaatttcccgcttcacatgtctgaccctcgttccaaactcctgaatctgcatgacatttacagtcgctgtcccttcccgtatctcgcaacggtttaaattaaagtcagaggccagggccagtcggcattttattgactggtaaaaatgatccggaaaaaccgcctttggaaaatccgggcttttttcgtgcttttttccgcttttatatacagcagaagggcaaaagctcaccagatcgtcgagtacaacgaaatcagccagctttccgggggcgatcatccccctgtcatcaaggtccattctcctggcaggtgtcagagtggcacagtaaatggccttttctgccggcattccctgctccacggccaacttaaggatctggtttaaatgccccttaaccagatggtccggcatggtgtcatccgtcacaagagccacattttcatatagagcgtgggacaccaccgtttccaccacatcaggtgtcagggattttgcctgcagctccagaaacatgcccatgtccgtcttttccagaactgactccggcgtctgctgggtatggtccgcatccacgccgcctctgataaagcctgccagggcttctcccgacagggcaggacaatgcccttcaatctttaaccggcgttctccgctttggcacagactgacgatccgcttgatcagggtatcatcacttgacattaagtccaggtcattcatcacctcaccaaggcagataacttttttctcctttaaaagctctttaacttcctcttcccccatctgtccgcctgaggtttccagatcagttcccgtggaaggaacactggacgggatcccgtaatagatgtccagttccgtttcctgttccataaagctttttattccttccaacccgtatacattggcgatctcatggggatcagccaccacgcaggtgactccccagggcaggactgccctggaaaactcctccggatacgtcatggagctttcgatatgcatatgaatatcgatcagtcccggtatgatatatttgcctgcagcatctaccacacattccgcctcatatttgtccctatgatatgaggaaggggaaatgtcgtaaaacctttcccccacaaccgcaatgtccattttttcaaaacattgcctgtatgtccggtagacccatccattttgaatcagtaagtcaaccttcatgtttcctctgtccttaattattgataatacggttccactggtcaatccagtcgcttaaattcggatttacaaaagaataatccagaactttagcacgttctgctgtttctccgtaagtcatgtttgcagcatcttccccggaaacctccacctggctgttggtaggcgcttcgtttaatgccttggtagtcttgctctgcagctccttgcttaagcggtaattgatgtatgcgtaagccagttccttatccttgcagttcttggtaatgctgatggtattgaagtttgcataggtcacatcaggtgtcacgtataccagatcagggcttgcttccttaatggtcggaacgccgaagtcgcctacaatggctgccttgatttctcctgaggtgaacatattgattaagtcggaagactttgcataggtctttacaaggtttggctttaattcctccaatgcctcaaaagctgccgctcctttatcgcttttcacgtcaacgcccttgtaatcgcttgccatgtaaaccatggcaggaccaaaggtggtggtgatatccggaatggcaacgcttccttccagctccgctttccataaatcatcaaagctcttgatctcaaatcccactgcctccggatcatacatgataccgatgctgttgatggtataggcaacgccctgcccggcgtctgccatggtctttgccgctttgatcagatattggctgttctcgatcttgcttaaatccagagtctcaaacagaccttcttctattcctttggcagtcattgcctgtgaaagctcgatcacatcaatggagctttcggagtttgcagaaagctttgtgtaacgttcattggtgcttcccgtctctgttacgatcttgcagttgtactgatcctcaaaaggcttgtacacctcttcttccgagatgtcctcgcttaagccgtaggtggataataccagtttcttttcttctgtgccgctggttttctctcctgcagctgttgttcctgcagttccggcaccgccgcagcctgttaataaaatagccgcacacagggataatgcaaatactttcttcataatcttgatcctctcctttttataattgtccggctttatcagccgttgttaccctttaatttctttgattctcgccatgctttttggcatacagggatacccctgggtgtttccttaatacttcccacccttaccgggcacataagtgcacccccaggctatcccgcattaagaaacaagaatcagctttgactccggcagataaaggcggatcctactgccctcttcgtaagtctcttctgccggcctgtttaccagaaactttcctgctgccgtaagtacctcatactgatagccttttccaagaaatgtccggacgcccacagttccttccaggatgttattgtcctgtccctgatctgccacccggatatcctccggccgtatggtacccatgcaggcaccttccctttgggcagtctctacgttaaatactgcgccggtcccggttttatatacgtctccctccttctttaagggaagaaagttttcaaatccgataaatcttgcaacaaattccgtgttgggtttttgataaatgttttccggcgtgtcaaactgttcgatcacgccccggttcatgacagccaccttatcggaaatggaaaagcactcctcctggtcatgggtgacgaacaaggtggtaatgcccagttttttctggatcctcttgatctccatgcgcatgttgatgcgcagctttgcatctaagttacttaacggctcatcaaggagaagaagctttggctcgatcaccagcgctctggcaagggccaccctctgtctctggccgcctgacatctgctggggaaaccgcccccggaactccgtaaggccgcagacctccaggatctgatccacctttttatcaatgtccgctttatcaagctttctcatcttaagcccaaaggccacattgtcataaacacttaaatgagggaacagggcatagctttgaaatacgatcccaaaattcctcttatggaccggaaccttcgtcaagtctgctccatctaaagtaaaaactccgttctgaggctcaagaaatcctgccaccacccggagagttgtggtctttccgcagccgcttggccctaataaggaaaccagttccccttcctgtacctctaaatcaagtccctttaaaatctgcttcttcttgtcataacagacatcaatgttctgcagcgtcatatatgccatggtttttcctcctatttcgccaaagcggctattcccagggtcttgtcaacaattaccataataaggaccgttatggccattaaaagcacggaaaccgctgacacagtagggtcgtaattatattcgatgtaattcatgagggtcgcagggaatgtggataccccgggacctgagagaaacatggaaaccggaatgttattaaaggagttaataaaggccagcataaaggctgcggaaattcctgatgtaatgttaggaagcaccacccggaaaaatgcccctgtttttgtgcaccctaagctccaggccgcctcttccaccgaaaaatcgaactggtctaagctggagcccaccacccggatcacatagggcagggttaccatgaaatgtccggccaaaagtccggcaaataccggaattcttaaggtcagcaccagaaactgataaagaacaaaaccgattacgattccaggcacaatggttggggaaaggaagatggattttaaaaccccctttcctttcatgcctgaccttgccagggcataggcagccgggatccccgcaataagggcggccacagtggcaaggagcgcaatttccagactggtcaaaaaggaaacccggaaggattttaaggcaaatacattgataaaccaacggaaagaaaaagattcaatgggaaaggtgatggcactgccctccccaaaagcagtcacagtgatgatcacaagaggcaggatcaaaaacaggaataccagcacggcaaaagcggtgagcattttatttttacgcattgtttcctcctcttctgtccagcctggccgccagggtatttaagcccttgatgacaaccagggtcgtgacgatcatgatcagggaaatgaccgcagccccattccagtctccaacgctcatggctctctggtagatgaaagtggcaaggaccatatgtttattgcctcccagaagctgaggcgttgtataggcggtcagggtaccggtaaacaccaggatgcccccacaatgattcctggaaggctcatgggaaaaaccaccttcataaaagccttgaacttgtccgcgcccaggctgatagcagcctccatcatgtcatcttctatattttccatgataccggccaccgtaacgatcataaggggaagaaataagtaaacggaaccaatgatgatggagaaatccgtgtataacagcttggcaggcttttccacaagaccggctgccagaagaaaccggttgatgatgccgttgctccctaatatattaatccaggcaaagcttctgattacagaattggtcatcaggggaaaaatagaaacagacagaaggatccccctccattttttcctgcaccggcttataaaatacgcggtgggaactcccgcagccatacagacaatcgtcgttataaatgcgaccttgaccgtcctcataaaaatcttaagataatactcatcctgaaaaaattccacataggcgctcaaaggatagtcccggtagaaaaagacgggacaagtacccttaagagcggaagaaacagacacactgccaatattacaagccctggcacgaccattataaatgcactacttttcttcatcctgacctccccgcgggttttacacatcattcattgtcaaaacttattattacttataagtacagttaatttatatctatacttttattataatttatgatatactgtacgtcaaatacatataatctatattttttatgcagtaaagctataataggagtatatgatcggaatgaaaaacattctggtaagccacctcatcacctgcacaaaagggggaacacctatggaactgaaagaagcaagatacattctggcaattgccaggcagaaaaacatcagcaaagcggcagaaagtcttttcatctcccagccatccttaagtaaatatttaaaaaacttagagcatcagcttggagtcagcctttttgaccgggttggaagcggttattttccaacttacatcggagaacgctacattcattatgcagaaaaaatcgtagaatacggcatggaatgggatatggaatttgatgacatcatgcatcagaaccatggacgcctaaatatcgccatccccatcatgcttggaaacagcctgatcggccccaccctgtccaaatttcaccggctgtatccccacgtcacggtcaacatgatggaggaggtcaattttgtagccgaacataccctgaccgaccacactgtggacttaaccttttacaatgtccatgaattccccaccggcctggattaccaggttataggaaaagaagaaatggttctgatattatcaggctcaaatcctttgatacagaaggcagaaaaaaaagaaggtttccaatatccctggatcgatctaagccttcttgcagacgccccctttatccttctctacccggaccagaataccgggggccttgccctaaagctctttaaggattacgggctgcaaccaaaggtcctgcttcataccagaagcagtgaaatgtccatccgccttgccatggaaggcttaggggctgcctttgccccggaaagctactaccattttctaaaagacagggagcccagctcttccgtctgcctttccattggaaaggaaaagatccaaaatactcttatagctgcttaccagaaaaaccggtatttgccgaaatacgccaaggcctatcttgatatcctggccggctattatcagacaaaacatctatagggtttagtcccggcgattcttcccctatttctttgcttttttttaaacttgtggtaatatagatttaaaaacgaggtttcctatggttagaagaatacaaaaaactattttcctttttatcctgattttattatcccttacctcctgccagatccagaaaaaggagacagcaagggaccttaccggaattcccgttgacacagaaaaaactgaatccgtttccatttactatggttccatttgttattctttttatgatgaaaataaagaaaccatagccacagtggctgatctctttcacggcttctctttaaaagaagttccagacggggcccttgatatagccaccacttatcagatttatttttccagctccgacggtcagaccggtgcggtaaatgtggacgaaaacggcatgttctatctgccggatacgaaaaaatattaccaggtagctgacggagcctttcacctggaagaattggaaaaaatatatcaggacagcatgaatgcaggcggcttagacaaaagccaatgcctgatccagtaagaaaggctttattgaaaggagactttatgagtgatcatgaaaaaacaactgcaattgtagggatgggcgcattaggtatgctctatgccagccagatttccgcctcccttggccctgatgccgttttctttctcggggaccgtgagcgaatagaccgttacagccggacgcccttctccataaacggccggcccttttcctttagaattcaggattgtgcaaaggctctgcctgtggattttctcattgtggccgtcaagtacggcgctcttccctctgctttggataccatggcggccagcatcggccctgataccaccatcatatcagtcatgaatggaatcgacagcgaggagatcattgcagaacggttcggccaggaaaaagtgctttattgcattgcacagggaatggatgccatgaggttcggttccaagctcacttttacccgtcccggaacactttatcttggaaccagaaccaatggacaggagtcccggctaaaggacttaaccggatactttgacagagccggtgtatcttataaggtagaagacaacattgtgaaacgcctttggggaaaattcatgctgaatgtagggatcaaccagacctgtatggcctttgaaaccgattacagcggagtgcttgctcccggaaaagcttacgacgccctgatcggggccatggaagaagtgatcgccctttctcaaaaagaaggagtcggcttatcggaagaagatatggctttctacataaatctgatcaaaaccctttcaccggaaagcgttccctccatgcgtcaggatggaatcgcccgccggtattcggaagtggaaatgttttccggagttgtccggcgtctggcggcaaaacacgggttaatggttccggtcaatgatatgctttatgagaagatcaaagaaatagaagcagcttattaaggaaaatcccgatctatcaaactcatctaaaagaccagaatgattttattcaattattaccattaattgctttgatatgatccataaatttcataattccaatctttttgcataaatataggtgagacaccagaatgtaaaaaggggcttgagtttggaaagaatacttgataataattattacgatctgtttattaataatgctctcattccattacatgaaattaactatgatttgacttacctcaatgaagatttttctttggaacatgttcccgtagaatctatgaacctttgtgacttaggcctgtatccttacaacagtttttcatcaatctttacgctgaattcaatagcaagtatagacagatcaggaattacagcagttcagagcaatcctgatttaagcttgtttggaaaagacgttttaataggaattatagatacaggcattgattaccggcaccaggcttttagaaacagatacggaaccacccgcattcagtccatatgggatcagaccatacaaaacggtgaacggccggaaagctttgcatttggctccgaatacggcagagatttaataaaccaagcgttgcagtctgatgatcctttatctatcgttccttcgattgataccaatggccatggcacggcaatttccagcatagtggccggcagcccaaccaatgaccaaaggttacgcggtgttgcttcggaagctgatctggtggtcgtaaaactgaaaaatgcaaaaaaaaatttaaaagatatctttttaataccggacagtgccctgtgttttcaggaatctgatattatgcttgccgcacgttatctctttcttgtttccctgcaattaaataagccaatggtgatctgtattgcccttggaacaagtcagggaggacatgacgggaacggtcctttaagcagctatctggattacctggcactgcttcccggagttggagttgcagtctcagcaggaaatgaaggaaacaaacaaaggcattatttcggcgcccctgtatccggattctcttaccatgattttgaattaaatgcgggaaatgatgacagtatgttctccttggaaatctggtcatattctccggcacagctctccatcagcatcacttcacccaacaatgaatctaccagattaattcctccggctctaaatagctgcttaaattataatttcaatttaagcgaaacaaacatctggataaataatattatttttgaacaaaacaccggagaccagcttatcctgctgcgtttccaaaatacctttccaggaatctggcatattcatgtagagaatatgaataatgattccttctcctttcatgcatggctcccgacaggtgacttgatctcaaacgaaacatactttataaactcagatccaaacgttacgattacttctccgggaaatgcaaaaagcctgttgacggttaccgcctataatcaggacaataacagcattctggaagaatcaggcagaggctacacgagaataggattaattaaacctgatattgcagctccaggctatcgtatcccatgtgcacttccggaaaacacatatggctatgccacaggaacaggagcggcggcggctcacacagcaggcattatggctatggtttttgaatgggcaattgtcaaaaagaattatatccagatgaccggcaacattattaaccggcagttaagttggaatgcaatgcgggatgattacaatacttatccaaataacatatggggttatggcctggtggatatcaatcgtttttttacaacagttaaaaatgcttaaactccagtgtcaatctgttcttctttcagtgatccgttaataaggacatctaaaaggactggaatctgtacgccatatacgtccgcagtcagttagtcattcccttgaaattcaaggcatgttcacgctgatgcgaaaaaaagaccggtgccaggacgtaattcccggcaccggtctacatgtattgtgattcctccgtgctaaagtatgtctgctgaaatactccatagtggctggagagtctgcaaagcagactctttattacatcctgccggtattttcgatatagtgaaattgctgctccaggtgactgatgtataacagcaatctttcatacagcggcaaaaccttatggccgtacttttcttcaaggcctttgccaatttcccaaacagttctgctgccgtcaatttgaagaaaaacccagcttccatactcatccatggcagtctttttatattccggaattctgaaaccaagttttctaaaaaaacgctggaccttgtgatcctgtttttcaagtatggtcacaatgccgtttttgtcaacttcatattccagttcatccgaaattttatatatgatatttaaaacctcatcattattatttaacattcttcacttcactcttaaaaatcggtattgcggtcgctgctacaagaataatcagtaagataaatgccattccatttgtgttcgcaaatccgtttggaccggtgcctttgataatgcccgcaacctgcagtatgattccgatcagtccgatgattgatccgccggcaacaagccctgacgacaggcttactccgttagaaaccctcacttcactttccctctcattttgggagtatttctccgcaaagaaacgaaccagggctcctatcaaaatgatagaggttgtggatatgggtaaataaaaccctattgccactgtcattacagggagtcccagtaaaaacaatacaattcccatcacaataccgcagatgatcatgacccagggtaattgacccgacatgattccggcggtcaaggttgccattaaattcgcctgaggcagtgcaaacggaacattgtcaccggtcatggaaagctggtttgaaagcaataatatgacgcaggtaactaccacaacgcctaccactgaagcaatggcaaaatatttctgcatttcagtcttatctccgccaatgataaaagaaactttttgcgattggcagtaacctcccgccgcagcgattgcagtgacgataaaggagccgaacagcagcaaggccttgttatcagccacgctcttccaacccaatcccacaaacagcagtgtgacaataacaatagaagcaattgtcattccggataccggaaggtttgaagttccgatggtaccggttaaacggccggaaacaatgacaaacatcaaggacagcaccatggacaaaacagcgccaagcaaagccatggcaaggttgccgcctgacaccaggaaaccgccgataaagcctatgataatacctgccagtaatataacagtttcaacagaagacccggcgccggcgccttttcctctggcattcatggtttcctttatggaagcgataaccgtcggaatcagctttaccgcaccgatcaggccgccggaaagcatcatgccagcaccgatatattttacgtagctccctgctatatcgctgacccccatgccgtttacactgacagcgggattattccatacggccgggccgccactgcctaaagaagcaaaatagccaatgagaggagtaacggcaaagttggataatatggaaccggcaaacatggtcacggacacctgcattccaacaataaagccgatccccagcagcaggggatttacttccagctgaaacttccatttgtaaaaaggctcatttacaaagctgatcacattgttggtgatatttaagaatgagctggtcaacatggttatcaaaccgcctattccaaatccgatccccataaacttaagtgaatctttagcgccttccgaagcaaccagggtttcagaaatagccattgattccggatacattaatttcccatgctcttccacgatcaaataattgtaaacaagagaagctgccccaataccaaacaatgcaccgccgactccgatcacaaagccttccagaaatgtcactttggaaccaatcaaaagaattgccggcaaaacaaatatcatgccgctggcaatggattcaccgccgcttgccatcccctgcatgagtgtctttccaagaatccccttttccctggcaaaaacagcaataaatacagaacccaatatggaacccggtatcccggcggcaactgtaagaccagctttcatccccgagtaagcagtcgatgcggcgaacaatgctgacagaagaataccaatgattaatactgtaatatttccgcccaatcctgagcttttggaaacgtatgggacgtagtcttttccggacacaccgccatatgctcctttagataatttttgattcatacacagtactcccttatattatatagtcattgcttgattcaataattgccataaattgaaacccaataaatggtccacctctatgccgctatttgagagctttcagcgcttctgtcaaatacttccatgtcctctgggtagacggaatgcttagatgctcctctgcagtatgtactccagacatggtaggtccaatggaaatcatatccaggtttccattaaactttttatcaaaaatcgcacattcaagtccggcatgaattgcacttatcagaggtttttcaccaaataaattctcatataagtctataaaaagctgtcttacttttgaatcgggattatatttccattccgggtaatccgattcagcagacacctttccattggtaaggccggcaatggcggcaacggtattataaatattatcctttatacttccaacagagcttcttatagaactgatgatctcaacgctgtcctcctttatctgaactactcccagattcaatgaactttctaccaacccctcaatatccatgcttacactttgtattccgtttggaatcagatacataaaattaatgatgttttcctttgtatcctttgacatgattcgttccggcatattttcagcaggttttagctcaatttttatatccggatctgctgttttgaattcatccttaaatatttcctccaaacgggaaacctgctctttcagttctgagacattgtcaatattaacacacaccacagcctgtgcatcgcgggcaatggcgttatgctttgaacctccacttacggagcataaatttaaatccatctccgagctcaagcttttcaaaaggcgggccatcaatttattggcatttgctctgcccttatgtatttccactccggaatgaccgccctgcagacctgaaatatcaattgcataagccgcccggctgggatccgggctttcccatattatgggaatactgatcctggaggtacagccgcctgcacagcttaccgtcaggattccctcttcctctgagtcaatattaataagcgttttacccgatacatttttgggatccagcacatgggcgccatccattccagtctcttcagaagtggtaaccaccaattccacgggcgggtgctccagcgtatccgatgccaaaaccgctaatcccatagcaacggcaataccgtcgtctcctccgagagttgttccgtctgcgtaaagcatatctccaacgattttcaattgaatcggatctgtcataaaatcatgggttacatcaggtctcttttcacataccatgtccatatgtccctggatcacaacgccggggctttcttcatacccctggtccctggcttcttgatgattacattcagtgctttatcctgtatgacctccagcttgtgttctttggcaaaagaaactaaataatcgctgattcttctttcatctcccgaacctctcggaatactgctgatttcctcaaaatactgaaacacttcaaccggttccacgtttaccaatgctttgttacccacggtatatgatctcctttactaaaaaattagccctctatgtgtttaaaaacaggtttatgggcaaaaaacccaataacatattaacacaattaagtccaaaatacaatagacttatttgtgcattttaacataaactttattcaacactttctcttgtaatgttcaaaaataccattatattttcaattataacctaatatttaggtaataattaataaatatacattttataaacctttcatccctgcccgtgattcgtatatcccttgatataagcaggtattgattaaaattcacaatgaataatgtacacaattttatattataattagtaatcatcctcttacggatcctatcattaatatcaatgtcaatggaacagcttcccgaaattggggctgaaatcacagctggaagtgatccagccggataagtaaatacgaaaaatacgaaaaaagtgcatttccccatggaaacgcactctttccgtatcagcctgaaatgaaaaactaacatagcaatctctgtaactgcacaagaaacacaatcaattctgcacgatgggttctatccccacatccatgcttccggaccggaatccctccaaatccatggtgatatatgtaaatcccaattcctttaagtaagagatgatttccccgctcttttccatcagctctcccattgcttcccggtccacctccatccggacgatgtctttatgaagccttaagcgcacatttcctttcacaagagagcttacaaactcttcgccccttccgacaaggctcaggacatcgtaattgatttccgtattgtaaggaagccgggtcgccatacatggagcagaaggcctggatgctacggagattccgtaccacgcggccagctcctttacctgggccttggtgatgtgaagctctgccagaaggctgatgattcctaattcccttaaggccgtgatcccgggacggtaaacatgaaggtcatcctcattggtcccatccatgatataaggaatgttctgttcctgggcaaaatcctttaaagactggaacagtttctttttacacagatagcaccggtttacaggattaaagcgtatttcctcctgctccagttcattgacggagactaccttatggattcctcccagctcctttgccactctggcggcgatctccagatcacaggaagggtgaaggcggctgtcaaaggttaccgcataaacgtttttccccgtctttcctgccgcatctgcggccaccttcagcagcaggctggaatccactcccccggaaaaagccagacaaatgtcttctttggcatactccgccatcgtctgttccagacgtttttttatttctgatatattctgctccattatttttccgcctccttgcgtatgataccgtatacggtctggtaatccagtccgctttgcctgcaaatacttcttacactttcaaattccggataacagaacgtcctgtccttgtaggtacagatttttacctcagctcctccccattcggtcataactgttcttttcttcctgtccagaatggtcctggaaaccggatatctcctgactccaatggtggtggtctgaatgaacagaatatcctccattctgctgatctccccttcccggcagatcaggctgagcatataggcaggacgattcttcttcataaagacaggcgtataccagacatccgccgctcccgcttctaataaagattccatggcaaaaccaaaggcttccccggtgcagtcatcaatattggcttccaaaacccacatggtttctcctgcctctttttcctcttcctgcagaatcatggccctcaggatatttgcctgcttaaagtcctttttccctgctccgattcctgtttttaagatccggaaggaggatggcaggccctttcttgtcctaagggctgctgcaatagctgctccggtgggagtcaccatttctccttcattgtcagtaagccgaagcgtcagcccatgagccgatgcaattgttactgttgccggaacaggaaccgggatgaccccatgctggcagcggacgctgccatatccctccgacagaggagacaccacgatttcatccactcccaggctgtccacacagactgccacaccgataatatccacaatggaatcaatggctcccacctcatgaaaatggacttcttccacagggatgccgtgggcctttgactccgcctctgccacgatttcaaacatccgccttgccattgcctttaccctgctgttggagtccaggcggtcaatgatggcgtaaatatcctggagattccggtggacatggagctgatcatgaccgctgatatggttgtggtcacggttgtgatcattttcatggtcatggcagtgactatggccgtgatcattctcgtggtcatgaccgtgactatggttgtaatcattttcgtggctgccgtcatgctcatggctatgcctgtgagcagtcccgtgtccatgatcatgctctttatcctccaggataacatcaaaatcataagcatccagcccgcatttcctggtcctgccaaaatgaagatgatagccatccactcccaggctctgcaaggccttagtgagtgcctccctgtccgctcccaggtccaaaagagcgcctacggtcatatcaccgctgatccctgaattgcattccaagtacagtatttttcccattttatctcaccgccagtcgattgatttgtgttgctatatatccggctccatatccattatcaatgtttacaacggaaattccatttgcgcaggaattcagcattgtaagaagagctgacagcccatggaagctggctccgtaacctacggaggttggaactgcaatgaccgggcattccgccagcccggcaatcaccgtcccaagagccccttccattcctgccacagcaataatacagctggcattcctgatcctgtccctttgggaaagaaggcggtggattcctgccaccccacatcaaagatccggtccacctggcagccgaaatattctgcggtctgcgccgcctcctctgctaccggaatatcagccgtaccgccggtacagactgccacacagcctttcctttcctttcccgggcgctccaccttcaggatcctggatatggggtcataacagacttcaggcacaacggccttaaccagatcaaactgttccactgacgccctggttcccagcacctcaccatccctttcatagaatttcctgtaaatctccaccagatatggatccggctttccctgacaaaagactgtctctccaaagccggaacgaagcgctctgtggtggtccagctttgcatagcccagatcttcataaggaagatcctttaacagctgctctgcttccctgatttccatttctcctgatttcaccaggttaagcatatctctaatctccatgatcccgactccctcctcttacgttgtcttattgttcgtgcaaatcaagccttcttgtgcatatgcgctttaaaaggccctcggaatggctgaccaccaaaaggccgattccccgtttcttcacttccgatatgagaaaattccagatctgactctgggtgatcaaatccagcatggtactgatctcatccgcaaggagaaacttagttcccccgcccagcgcccgggctatgcagaaacgctggagctcacctcccgaaacctcggcaggataccggtttaaccattccgcttcaatgccaagtccttctatgatccgtttttccaccccatccccctcttttaaaacctccctaagcttaagccttgggtttacagagctttccggatgctgccagatcatctggacagggcaatagcccttataagaagaaaggggctttccgtctaaaatcacctctcccttgtccggtctttcataccctgcaagaatcttgcagcaggtggtctttccaaagccgctgggagcaatcagccccaaacggtccccgctgtccatgtgcatggtcaaatcgtttaatatctgtctattcccattatcataccggaatgatatgtttttagcttccagtctcaccttatccctcctttacctttacacaccggaccattcctccccgcaggccaacgtattccacttccccggaacaccttgcttcccgatgctcacatctgggactataagggcagcctttaggacggtcctttaagtaaggctgggttcccggcgcagcccaaaatccatggtcaggcatggccctgtaaagggcctttgaatatggatggcgcaggcatttttcctccctgaaatcagaggcagatgcttcctcaacgctggttccggcatagaataccacaatgcggtccgcaatttcaagcgccagttccagatcatgggtgatgagaagcacccccgccccttcatcggccatttcccgaaaatgggacaacaccctccttgcggcctccgcatggagtcccggcgtaggctcatctgcaatgaccagtcttggtttttccatgacagcagtggaaatcaggattcttctggtcattcccctgacaattcatagggatacaatcgttccacgctctcatcaagtccgtaccgtttcagcgtttttaagctctccccctgctttccttatccttcctccctttcctgatctgaggtccggctttcattaagggatctaaataggaaacactttggggaaccagaacgatctcctttccccgcagcttttttctccgctcttccgtcagcttctctccataataggagatatctccggtccaggccgcattataaggcagaatccccagaacaccatgtgccagcaggcttttgcctgatccgctggagccgaccactgccaccagctccccttctttcacagtcaggctcacgtccttgacagccaaaagagtggtcctttgtatccaacgctcatattgggtgaatgacaccgataagtgctctaccgacagaactgttttcttctcttccaatccattccctcctactgatgtacaaagccgggatccataagcctgctcatcatttcccctgttaaatgaaacagcagaactacaaccaccagaaacgctcccggaaacagggcaagccaccatttccccattgccaggtacttcatgctctccgacaaaatcacgccaatggccggctgctccggagaaagcccgaagcccagaaacgtgatgctggcctcatgaaggattgcatgaggaaataacagcacaagccccacaaaaagctgcggaagcaaatgaggggtcatatgcttaagggctgtttcaaatccgccatgaccaagcttacgggaaatctttatgtactggctctccttaagctgaagaacctctccccggatcagccttgcaagggaggtccagtgagtcagggatatgcctatcaccactcccttaaagccctttcccatggcaaaggagatcagaaccagcaaaaggatgtgagggatccccatgacaaggtcaatgagtccgatcacaagcccatcagccacctttcccatggatgccgcaaaaagccccagaaaaaatgccataaccgtgctgacagccgcagtgagaagaccgatccggatgctcatggaaaggcctgtcacggtccgggcgaacatgtcccggcccagccagtccgtaccaaagggataagaaagacagggcggcatatttttcctggaaaaatcagtgaccaaagcctctgtcctgtaaaactgcccggcaacggccacagccgtcaaaagtgcaataaaaactatgaggagacagaccatggttttccggccgttccattgtttcatgcgccttccctcccttttctcattctcggatccactgtgccgtaaagcacgtttgccgtaaaattccctgtaaatacaatggctgcgctgatgacagtgatccccagaagcagaggcacatcacctccaagtccggctgtcacagccgcctggccaaggcctggataagagaatacctgctccaccaggaccgagcctccgaagatttcgctgacagaagcaagctggagggtcatggcgggcagaaggacgttcctgatcccgtggcgaaaaacgatctggcttttggattctcccctggcccttgcaaaaagaacgtaatcgctttccaggacctgaatcattttccctcttgtatgaaggaggatggcagacatcccggaaacagaaagggtcaggcagggaagaatcccatggatcacccggtcctttaacgtgacctccgccgcttccatgccaatgggaacgctgagcccgatgggaagaatgtggagccgtacggcaaacaccatcaaaaacaccagggccagccaaaaagccggggtgctggcagtcaccagggcataagcggaaatcactttatccaccgtctttcctctgtttgcacctgccaggacccccagggcaaaaccggctcctccggaaaccacccaggaaacagtcataagccacagggaatttgacagcttcacgccgattacatgagaaacaggctgccggtacaaaagtgaagttcccatatccccttttataaaatcgccggcccaggaaaggaagcgttccacaggcggcagcccggtccccaatacagggaaagctttgcgatctgctcctggctcatggagccaagggctgcctggcccacattgacctttaaaggatcaatgggcgaaatcgataccagaaaaaaagccgctgcatttaccagaaaaagaaggactgccatccgcccaaactgtttaaataaaaaccaaatgatcttccttcctttccagctgtttttcatgatccccatctccactgatctacattatttacgatggaccagccatgtccatggggatgaagcttctggtccgcaacctttaatccatcccttacccagtataaatgatcgatatttacaagccagatccaaggaatatccccattctgggtaatgccggtttccccatcccactgggcctttttccacagctcataggatttttccagatcattttgtgccagggcttcatccatgtactgatccaccttttcattggcataaggggaataggccgcaagccctgtttcctccatggtatggtaaatattataaagctccatgggcgtgtgggctccccagccccagatcaaaggctgtgactgggctctgtcgtaggccgtgtcccagccaactccttccatctgcccgtcaattccaatctttttcagctgattgacagtgtccgcggcaagggcctgccttacggaatcgctggcaggatagaggaaatgaagctctgcccgtttcccatccttttcacgaatcccgtccccgccctttttccagcctgccgcttcaagcagagcctctgccccttccgggtcatactctgtttttgctgaaggctcataccacggcattttgtcacagacgctgtaggcaggactgccgtatccgttcagcacgtgatcgatcatttcctcccggttgattcccatattgacggcccttctgaccattacatcactggtaaaatcatttcccatgggcaccccttcttccgatacgcttccggaaggaatgacaggaaggttaaagccccggttatccactgttttgcagtccaaaagcccaaaccccggtactgttaaatccgaataggacgctgccgtataggcaacatcagcctgcccggactggactgccgccaaagccgcatcttcctccataaaaaggaccgtgacccgtttcatctttggagcctctccataataatcgggattggcttccaggatcacctgctgccccctgtcccactgctttaatatgtaccggccggacccgatgggatgttccccgtaatccgcaccatatgcatgttccggcacgatcccgacgattgccatggtataaggccagatggaatacggatgcttcatataaaataccaccgtcgtatcatccagggcttcggcccggtccagcatggtaaaatcattgaccgagctggtatccctcagggtattataagtaaaggccacatcctgtgcggtcagcttctccccatcagtaaaggaaacgtcattccggatcttaacggtccaggtcataccatcgctgcctgcctccatatccgttgccagatcgtaaccaatgttcaaatccttatccgtaaccgtgagtgtgctctgaatcaaaggctcatggacatgttccccggctccccagccataagccggatcaaatcctgcttcaggctccgaggtgactcccattaccactacaactccgtctttttccccggcggcctctgtttcagaagcttccgtaaccgtctgggcctgccctgcagcctgggtcccgcctgtctttccacatccgctcatgaccacggcagacatcataaaagccgcggcaatcccccatttacactttatcatcgtttttcctcctccataaacggccataccagctccggtattttccgcaacaaaaacagataccagaaacagtcatacgtattccttgggaatacccataccttcctggtatctgtttttgtttattgttatattttatacattctgtcagtggtgacttctgtcagccgttataaaaaagtatacgtaaaaacaattcatacgtcaacggctttttatgcaaacgtttgcaaaccccggcgtcttaagatatttcttttagtaaaatatcccttaaatatccgccgtatttttccttagtcaggacaacccggtacccctgctttatcatattgttcctgctgtatttattttccggatggaccgtgcacatcagatgccggaagccctgtttcctgagttcttcctctgcagtcttcatcagaatatactgaaggccgtttccccggtattccggaagaatagccactgactccatatgggccacctttcccagctcttcctgggagaggccaatgtcccggccaaggttttcttccctgtctcccggcagtgcagcaataaatacaccggccagggtcccggattccgcttcaaaggccttgtaaccgattccgtttccctctgtcagggtatggcgggtgtattctgaatcatcggcaacaaaccagtccttctgctcaatctgctgccacaccgactggatcacatcagccatgatcagataatccgagggatctgccctttcaatcaaaaattccatgcttcggtccttcctcctagattacagactccgaaagccccgctggctcccaaaactcctgttgaaggacctggaccttttcccggggtacttccagatccggaactgcattcccgccatgaaaccagctgtacataccggcgcaaagcaaaatcatgatcaggcaaaacgcgatcagcatgatcttattatataagttcttatcctccacaccgtttcccctttctttcattatgtaatcagtctatgcttccggtacagtacaaaataacaccggtaagctgtttcttaaacattccttgtaaaacggcactggggaaaattggaacagccgtaaaattgtccaaattttccgctgcgaagcttaagcaccccgccgcattgagggcaaacttcagcttccactttattgtccagttttcccatctcctcatagcacttctggttcatgatacaatcagaaagtgcccggtgagctccatccgtatcaatatggaaatacgcagatatatccgtcaaacggtggcgtccaagctggggaaggcaggcctttgccataaaaagagtatccacataatcattgggcacccctattccaagaagctcttctgcagcccggtaaaggaaaagcaagtcaaaggactggatattgtgtcctaccaggatctccccttcgataaaggtaaggaaatccggcagggcttctcttaatccgggagcttcccttaccatgtcatctgtgattccatttacgttggtagccccggccggaatatgagtcccaggattgatcagtgtatcaaattcggctacaggttcatgtcccttcaccttgatcgcggatatctcaataatggaatcctcttcaggactgatgcctgttgtctccaagtcaaatactacgtaattttctgcgtattggttcaaacgtctgcctgcaaactgtctgacagccataggttcctccattcttttgtatgtaaacaggatacttgtaacacctccattataccccctatcctttcatacatcaagtaaaagtcaatgaagggcaaccatctgttccgccactgtctccgcttcttccgctgaaaagtatccgcatgcctccattctctgaagaactttcatctgccgtttctctgcaagaaccgggtttttggtcggagcatatttggatggggcattaggaacaccggctaaaagagtgctttcatactccgtcatttcctccggcgttttcttaaagtagccctcactggcatcacctacgctgtaatatccgtccccaaaataaatgcagttcacatacagctcaaaaatttcctccttggaataatttttctcaatatcaaaggccatgaacacctcggccgctttcctggcaatgtccttatcctggtcaaaatataagttctttgcaagctgctgggttatggtgctgccgccttccacaagctttccggccctgatatcgtttgtcactgccctggcaatggcaattaagtcgatcccattatggcggtaaaaacggtgatcctccaccgatatgactgcgttcacataaatctggggcaggttatcatattccgtatagccttctttatcccgaacagactccacacgttcctggagtccggttccattaagagcctcccggtacatctcataccccttatatgccacagtgaatccggctaaaagacacactgtcatcagcaaaaataccattcttcttataaatgttccaattctcatagatccactgtctcctttcctctttttcgcccatgttttttgggcatataagtatacccgaagggtatttcctcttaaatcctcccacggtctttgaacatatagatatccctggaagggcatttgttatatgatatgctatggttatgactaaattgtaccatagagttcctctgaaaacaggaataattccttatatttccctaaagttttcggacaagttctgacaaaactcttaccagttcttacaaattattgaaaggatggaaaaaatcagcatttcacaggcaacaaaccgcctgtaacacgctgatttccttttttgttatcttatataattcttccagtcaaataccgggccatgctctccccagccaacctttatcgcataagcatgccggttgggatcgtagagaggatctccggagatctcatcgtactgccttgcatgatataccataatatcctgaagcccgtcttcgctttttacaaaacaattatgtcccggaccaaaaattcctgcttccgctactgtcttaaatacaggctcccgctcctttttccatgcattccgatccagcaaatctccatctccatcaatgcttaaaagtcccatgcagtaacacgcccctgtggcgctggcagaataagtgacataaatcttattcccatgctttaaaaccgccggtccttcattgacccaaaaacctacccgttcccaatcataatcaggagcagaaagagtcacctgctccgatgaaagcttccagggtgtctccattctggctatgtataaattggaaatcttctttcctacgctgaccttttctgcccagatacaataccggctcccgccatggtcaaaaactgtcatgtccagggaaaaatcctgaaacgtataatcatcaaagggctgtaccatgcccagctctctccaggtacctgtcatcgggtcttgttccctgcattccagcacataagggcggatagcccagacgtcctccacatcccctgctgcaaaataaatgtaccacctgccgtccatataatgaagctccggagcccagatatgtgcgctcatgatccctttccggtgtttatcccagatagtcacttccttttcatcctttaatccctggattgtttcggaacgccgaagaatgatcctgtcgtattccggcaccgatgcggtaaaataatagcttccatcttcatggcggtatagataggggtctgccctttgagggataaagggttcattataaggggttttcttaaaattacggctgtccatcctctgccacctctatcctttcacagcccctgccatcattccttcaatgaagtatttctggaatgccacaaacaggaggaatatggggatcactgagaaaacagagcctacgatcagaaggctgtaattatccccatatgggttgatgagggtatttaagcccagggtcaggggatatttttcagaagaccggatcaccaaaagaggccataaataattgttccacgcattcattccattgagaatggccatggcggaaaacgcaggcttcatcagaggaacgatcagcctgtaaaaaatcccgtactcggtggcgccgtcaattcttccggcttctaaaagagatcctggaatgctcatcaggtactgcctgaagaaaaagatcgtggaagcatgggcaacaaaggggagaatgactgctgcatagctgtccatcatcttccagccggacatctgcttatacaggggaagcataaccacctccaaaggtatggaaaggatcagaagaacgatgacaaacagcaccttttttcccttaaattcataagctgcaaatccatatcccacaaaggagcttacaaacagggtgcttaccaccgtaacaacggtaagggagatgctgttaaagaaccatttccagtattcatgctgccctgcaaacagcagaacatagttgtccagactcatcctggaaacacgaatgtccaggttaaggccgtattgcagcaaatcactgccaggcttaaagctggccacaaacaacacccaaatgggaaggatgatcaatatggcaagaatggaaaacaaaacgatcagtgctgccgctgccgccgttcgtttgacctgcagatttgatgtatttctttccttcatttcattccctcccttcttcaaaggtacctgtgattttcagctgaaggaggtttaccaacatgacaaccagcagaaggatcaggccaacagcacacgcataacccagggccctcttttcaactccctgccggtaaaggtatcccacaatggtaaggccgatgttattgggagaattatttcccttaaacagcatattgctttcaagaaacatggacaggcctgcataaatgctgatcgtaaggacataaaccgtggtaggcttgaccaggggtacggatattttggaaaactgctgccacttggaagctccgtcaatggccgccgcctcataaaggtcggaaggaatgctctgaagtcctgaaagaaagtacagaatattcactccagtccatctccagcaggccagaagcaaaagggcaaaataactggttcctgcacctttcagccattttatgggggctgctccgaaaaaccccagaacctgattaaaaagagaggtagatgactccccgaacataaggcggaaaatagtgcctgccaccacaacagaagtcagcgccggtatgaaatagacggatttaaaaaaatctgcctttttcatcagcctgctgtttaacagggtcgcaaacagcattggaaaaggaatcagaagaatcagcgttcctgccatatatttaaagctgttccacaatgccttcataaatattttatcagacagcagccgcgtatagttgtcaaatcccacccattgctctttcaatacatcctgaaagcttaacagaaccccgttgcagatgggtacaagccagaataacagtaccgtgatcacaaacgggcagataaatacataaggagctatctttttcgagtaaaagaatttcttcattttgtttaccccttttcccataggaacttaactttgggctgcaggagacaaccggcctcctgcagccaacagcctttcctattctttaaattcattattcagggtttcctgggaggactgaagggcctctgccacatccaccccgtcttcaaaaatactgtttaaggtcacattgcagaattcattgttaatggagggatatttttcatcggtataagcccgcaaggagccgataccatcctttgatttaagcagagtatcaaaggggtaattggtaaaatactgaacaaactggttatccgggttttgtgtcagggaggagtctgtccatactgcagtattgaccggatcaaagcccaatacattccatacttccttgttggcatcctcggaaagcttgatataggccatgacttccgcggcaagctgtgcgtgttcactggatttaacaatggcagtgccagtaccgcctccgccgatggtggctgcttctttgtcattttcattccataccggtaccggggcaatggctacctgcttttttaaatccttcatataattcacatatctggaggtctgccagaacggcatgatctgcacggcataatctcctgagttatagaatgggtaggcttcctcattatccggctgcccgcctgggaccgttgcaaatgcgccggtttcctgcattccctttatgtattccagaacctccgccatttccttgctggtcaggttgagcttcccgttttcatcaatataatccccgcccttttgagccagcattaagttgaccatccactgggcagaggtctccacgcaggcgaaatatttcccggtggcttcatggtacttcacgcctgcttccttaaactgatcccaggtcttaatatctgcatagttaattcctgcatcacttaacagcttttcattataaaatgccaccgttgttcctacatgggtgggaagcccgtactccttcccgtcctttgtgtaaatatccagtctggattttacaatgttctccctgtatggttcgatcgcatcgttaagctccatcagaccgatctttcccgtcataaatgcaggaaacttgccaagctcaatatccacaacatccggcgctccctcccctgattccagcgccagggacagcttgttgtgcatgtcgtcatagggcatattgctcagcaccagcttcacttttttatccggatgggcttcgttccatttctctgccattgccacataaaaattctggtgcagttcaataaaagtccaaacatttaatgtggtcacgtcacttcccccacatccatttcctttttcccagcagaagccgcgcctttggtggtttcctgggaatctcccttggtactgctgctgcatccagtgatcatggatgctgccaatgctgcacacagcagccctgctaatacccgttttttcatgataaatcctcctttttatattcctgctttatcaaatcagatgatatcatctgtatgattcctaccggataagttcctttatccataccgtcatctctcctgttttcctgttcccccagctgctgtatggcactgctttcagatcaatatttaaaagcccgatcttcctttctccgtacagctggttttcctcccactgatcctcacagatctttttccccttaagccggacagtcaatgtccctcccatgagatcaggctcaaagatttcttccagctcctggtctgcctccacgtaaacagcggccagattatccccattatcagcctcttccaggcaataaaccaccggtccctttacaatggccacttttcctgcatcagcccttacctttggattggcccggatcaacagggccggctgcctgaaggtgacagtcagtgaggtctttgaaaaatggccggaaaaacaggcgtatccctttctgatctctgtctggatcagccttccttctccgtcatggatcttaaaatcctgggcataagagggaatccggaatgctatagttttttcagcaattccctcactttgtatttcaatgaggattttcccagctccgggagtctccgttatcatgcgaaaatatgtcttttctccggaaagctctgtttccacctggctgcccacatataaattcacatacagggtatggtcgtctttaaaataaatatattgtccaaaggatgcaagggtcctggcaatgttaggcgggcagcaggcaacaccaaaccatttctgcctcttaggtcttacgtgttcctttgatgtgcggggaatgcagctatccggccatacctccaggggatttacataaaagaagctctttccgtcaagggcgatccctgataatactgtgttatacagggaacgctccaccccatccatgtatgaagcatcctttgttatctctgccatccgccttccaaacaatgccagcccaatggaggcacaggtttccgaataattgcagtcattgggcaggtcataatccgccgtaaagcgttccagaactccggaggagcctatccctccggttatgtacatccgttttgtcacaatattctgccaaagctcttcgcacacatgaagcagttcttcatcctcatattcatgtgcaagatcagccatggcgcagtacatatatactgccctgaccgcatgtccctccgccgttttttgctgcctgaccgggatatgggactgggaatactttggatcatatcctctgaattccggaaaaatataccggtcttccctgcgtctggcctcggctagaaaataattctctcccactccccgctgatcaataaaatactttgccagatccagatatctcttttcccctgtaacacggtataatttcacaagagccagctctatttcctgatgaccgggatagccatggcactgcccctcccctggtccgaaaaccttacagattaaatccgccagccttgaaacgatcgtcaggaacttcccctttcccgttgctttaaaataggccactgccccttcgatcatatggcctgcagtataaagctcgtggccctccataaggtttgtccacttattttcaggctccctaataataaaatatgtatcaaggtagccatcttcctgctgcgcccttccgatcagttggatggtctcgtcggcaatcctctccagctcttcatccggatggcattccagggtataggccactgcttccagccacttcgccacatccgtatcctgaaataccgctcccttaaattctccttcttcctcaccggcggcaattttaaaattgtgaatgcaatggcttggttctccatcatctgttaaatcgtttaatatactccattgataaggtataatcacttccttcacaagtccaatgtacctgtcccatgatctatcattgatttgaatcattttcagtggaatattcgtcgattttttatccattatggtcacctcatcctctgctttttatattaaacgtttaatatgagaaataatattaaaggtgattttatcagttgataatcacctttaatttctataattgcatactaccacatggaatttattctgtaaagtatttttgcacaatttaataaatttattaatcgtttaaccatgtaatttttacttaatttttgttgtaaattgtagaactacattacttgtcctggttttggatcacaattatcaaaaaaactccttactcttctgtttatttttattgttcgttttttctgctattttataacttctcactctttaccactcattctttgccctacagcttccttaaaccactacaaaaagacagaaatagttggaagccttaatgattttgtaccgcttttagcggcattctcagcgaaaaaaagaacgttttacatggctgatcccatgtaaaacgttcttttttgtaagtcaatcccggatatttgcaatccgcttcgctgcttgatgaggttaaaccatgaagcagcctctatacaatgcactttaccgatttccggaccagcagcttgcagcccacggaacagacattctcggagtcggtttccagctcctgcccgtttaaaagtccgatgaccagctcactggccttgtgtccgatatcgtgaagaggaagccttatagtggtaaggggcggccggtaataccctgataattcccggtcatcgtatcctgccactgataagtccgcacccacgttcatgtccaattcctccaggcggtcatacactccccctgccattaagtcgttcatgcagaaaatggctgtcacttccttttcaaggagcaggcctgcacaccggtagccggactccctggtccagtccccttccaccacaaggcttggatcatataatatcccattttgaaaaaggacctgctgatagcctaccagcctggcctgtgcatgaaggctgtcaggctttcctgtaatcaccccaactctcttatgaccgtgttccagtaaatgctgcatgatttcagcagcaccatggacatcgtccaccacaacagaaggcactttcatgcttttggagtacccgtaggccattacggcaggtattggcagcgtatcgggaatacagcggatgaccctctcatgggcagccacatagatgatcccctccacctgtttttccatcagtttctttatctcaagccttaccagcccataataatcatcccggttataataggtgtcatcgtattttttaaacagccttaaattcgttaaaagtatctgataatccagctcctggcaatagtccgtaatgccgtcaatgatgtcagggatgctgaatatggtcatgtcctccgcaatgaccccgatacttctcgtcttttgcagctttaaattctttgcaacaacattgggagtataattcagtttttcagccatctctaaaacaagtttcctggttttttcacttgcgcctggtttgttgtttaagatatttgataccgtggccactgatacaccacagcattttgccaattcctttatggttgccatctcctgcctccagaaccttttgctttaattaactcagattttcatggaattgtcaataggacaggaaaaaatattaaacgttttagttactgattttttgccaatccccatggaattttcctttttaatttagtatacttatcatagaacaagcctgaacgcttccatgcactgactggaaggaccattcaaagggcaaaaaatcgtacaaagaaacgaggtaaattaaaatgctggttacacttcacgattccaaagcaacggctgtcatcgattccatcggtgcccagctcatttcattcaaggattctgccggcacagaatacatatggcagagagatcctcaattctggggcaaatgctctcctctgcttttccccattgtaggaaactgccgaaacgacaggacccgcatagaaggccaggtatgggaaatccccaagcatggtttttgccgggaaatggattttactgtaactcatcagtcagaaacttccgcttcctttgagatccgggataccgatgaaacgaaaaagatttatccctactctttcctcttaagcctttcctatacccttacggatggaagcctgttcatggaataccgggtcgtaaataccgatgacagaaccatatattactgtctgggcgcacatccgggctttaactgccccatggagtctgaggccgcatttgaagattatgatctggtatttgaaaaagaagaaaccacatccagcatggtatacgactgtaagaacctggaatttaatccggctaacaggatcagccgtctgaaggaaagccgcacactctctttgaacagggaattatttaaggacgatgccgtttattttgacgacctccagtccagagcggtttcaattataaacaggaatactggccggggcgtggaggtttcctttccgggctttgaaaccgtagccttctggactccttatcccggagatgcgccttttgtctgcgtggagccctggaatggttccggaatctacgcaacggaggatgacgaattcatccataagaatcatgtacagtccttaaatcctggaaacgcaaaaagctacggcctttccataagggttcttaaccaataagaaaacaggcagcgaaatcggctgaagtttcgctgcctgtcctgatttattaaaatatgaagaatttttcagatgtgatctgccgacttttgaaatagaatttttatctcgtttgatagggataacaataccatggtctccttctcaaaacaagcaggtttgcgttttttaattgaattgctgcgcttttttaaaatattactacaatatcatacaattcctttttaaaaaatccatgtatcttttttcaaatttcttttttctcccttcatttacatacaaaacctcaccattgtgcatctccactttctctccctttacgctccttacatacagcatgttaatgatattatgcctgttgattctcacaaaccggtcttttggaagccttttttcctcttcatctagctttgccctgatccgcatccggtcatttattgttaccacgctggtttttctgtaataggattccaaataaagaatatcccagatatccagaatgcaggactggccgttaaagaatacagaatattttgtttgatgcaggtttatgttcccttttggataaattacaattatatcatacgcggaacactccaacgtcagaaaacatccctcctttatggtgaaataatcagcctttggcaggctgttccaggcgccggaacagactttttccggcaccggcgtctgtttttcatttgtaaaaaaggcaatcctcatttccagttcccccatatccactcattcactcatggaccataatgtcccgcaccttatagaacgatttccaataaagcttataacgcaaaaacaaaagagatcgtatggacagcgaataattacgctgtttttcctcaaactaaaagaagagattgctaaaaagactgccggaaggagaatgtgaaatgaaatcagaaaaaaaggaaagcaaaaagaaggcggaatcaaccacctcaaagaacaattatgacatcgacattcaggcctgctctaccatggactgcacaggacttattccctcggctccccagtcagaggccgaactggaatcatatgaagatctttatccctacatgccccatgcaaagagcaagaacgcagataagggctgagaaaatgaaatgaaaataagaaggcccttcaaatgaggccttcttatttactgttcttaccttaacgaagccggaatttactcattaattcccgcaggctttccgactggctggaaagttcctcgctggccgcagcgctctgctctgcggtagcggagttgttctgaactacggaagatatctgctcgattccaaaagtcacctgggtaaccttgtcgctttgctcctttaattcctcagcggactctctgattgcggaaaccattcccttggtttcagaaagaactccattcaaggtttcccctgtggacgccgcaatgccggttcccttattaactgctgcaatggtgtctgcaaccaggctggaggtatcctttgccgcattggcgctcttgcctgcaagattgcggacctcatctgcaacaactgcaaagccttttcccgcttcacctgccctggccgcttctacggcagcattcagagcaagaatattggtctggaaggcaatgtcttcaatgagcttattgaccttttcgatctccttggactttttattgatctgatccatggactgcatcatttcgtgcatttgggcattgccgctctccatggcctgtccgacacgtcctgcctgcttattcacatcttccacggcctttgcagtgctcataaggctgtttgatatctcatttactgaggaagataattcctctacagaagccgcctgttccacagcgccctggcttaagttctgtgctccctgggatacctgtgcactgccctttgccacttcatctgcagagatacttatggtttccatagtcttagaaagtaaatcttccgctctgtcaatggaatcctggatcaccttaaaatctccctggaattccattccaacggaccggctgaaatctcctgctgcgatatttcccaatacggaggcaatctcagtgatataggacttcacactgtgcacggagctggtgatctcatcagcaagctggccgatctcatccctccgttttaccacaggtacctcactggacaaatctccttctgtaaacaatttcattcttgctgcaatggctgataccggccctgcaatggatcctgcaaaccaaaatgccaggaagcagcccacaaccactgacacaagagcaaacacgctcatggcaaaaactacaagatagatggaagaggtggtttcctttactggggctaccactcccagagcccagccgtcgctgcctgttaccggactgtaatagcaaaaacggtcatctcccatgtattcatatttgccgatccccgctttcccattcagcatggtctgatacatgccaccgacagaagcataggatttatcggtctttgcaagctcaatatagttctggcggtcaagaacctgttccggtgttctgctggcgattttggttcctgtattgtcgatgataaaggcattgccgctttctgcaatccgcaggtcaccgatgaggccgcttaaaattaaaccgtcataagttcccagaagaaccccatattcataaggagctgcaacgcggatcaccagttcattgttggcatcatattccgtggtggaaatggtggtctcgccattcatggctcttgttaagtaatcagaatccggatatttctctccgatgttctctccgcttgcgctgcgggtgatggtaccgtctttgttgattacttcaagatctttgtacccgtaaagcttacactgattggaaaggtattccgtcacaactcgggaattgatggattttaagcttccaccctgagagctggcttcaatgctcagcttcatctgattcaaattctgcacgaccagactgtttacaagcttacccgttgattcaagatcacttttcacaacatctgtaattcctttgtaactgactgaaatactgatcaccatattggtcacagccaatcccaaaataattgcgatgatgaataccagcattttcatcttcagtgatttcagaaatgtacttttacttccttttttctccagctttacttttttcgtcgtcagtaacgccttcaggtttcgtttcttttcccccgatgtcttcattgccttatgctcctcgtctttggtaaatgtaaaccataacactttgctcatggtttttctcattatacaatattttgtaaccatttgtcaacgcatccagaaaatgacagagatttttgtcgaattttcgtaaaaaagaaattgtaattcggtatattttcttttttcttctatcagaaattcacaaacaaaaagaaaaacagcctcttcctgatctgcagctgcccactgcaagccgaaggaaggggctgatattttttaagctctgtgtctctttattgttttattttattttaaacctgtttttattatatgatgaacctgcggttcatcatatcctgattacacgccggaataagcagagaatccgccgtcaatgggcagtaccacgccggtaataaagccagctgcttcattatttaagaaaaataataaggcaccgtttaattcctccgcttccccaaaacgtcccattggagttgcagacaagattttgttggttcttggcgtaggggtaccgtcttcatcaaacaaaagcttctcattctgcttggttacaaaaaagcccggtgcgattgcatttacgcggatgcccaccttggaaaaatgaacagccagccactgagtgaagttgctgatggcagcctttgctccgctgtatgccggaatcttggtaagaggagtaaatgcattcatggaagaaatattcaaaatgctgcagccttctcttccaatcatatcctttgcaaagatctggcatggaagcaaagttccgaggaagttcaagttgaaaacgaattcaacgccggactgatctaagtcaaaaaaggattttgtatccgcctcaatgtctcccatttcaaagtattccttatccgtattagctcttgcgttgttgccgcctgctccgttgatcaggatatcacaggggccaagctcagccaaaacctttgcatggacttcctcaaggcttgtgcgctccagaacattaaccttataagcctttgccttgccgcctgcttcattaatagatacagcaacttcttctgccgcgctttcgttcaaatccagaacagccacctttgcgcctgcttgtgcgagagtttttgcgaacatgccgcacaatactccgcctgctcctgttacaactgctaccttgccgcttaaatccgttccaaatgataatgccatatgatttccctctttcctatttgctcattttttcaatggcttcccaaagaccatttaaataggttgctccaagagccctgtcataaagcccgtaaccggcccggcctgtttctccccagatcattcggccgtggtccggacgcatatagccatcaaagccattgtcatgaagagcctttaaaatagcaaacatatcaagagaaccgcatgatgacaaatgagccctctcttcaaagccctgattgtcctccaaaacggccacgtttcttgcatggacaaaatgaatgcgtcccatagccgcatatttggcagccattttcaccacgtcgttttgattggagcagcctaaggaaccggtacaaagggtgattccattgtgcttatcatccaccagctttaagaaacggtctaagttctcttcgcaggtaataattcttggaagaccgaaaatgctccagcagggatcatcctcatgaatcgccatatatacgccgcattctgatgccacaggaataattgcttctaagaaatattttaaattatcccaaaggtcatcctctgacatggcattgtactggctgaccacctgctttaactcatcccttgtgtagctggaatcccagcccggaagggtcaagtcgctttcgctttccagaggatttaccttgtccacctgatcctggtaataaaccaaagaagtagaaccatcctccaatacatgatccagctgggtcctggtccagtcaaacaccggcataaagttatagcagatgcacttgatccctgcttccgccacccgcctgatgttctcgcaataattttcaatgtatttgtccctggatggctttcctaatttaatatcctcatgaaccggaatgctttcaatcacttcaaacgccagcccggctgcttctgtttcctctttcaagtgggcaatgctttcccggctccacacctctccgactggaacatcgtaaacagccgttacgatggaatacatgcctggaatctggcggatgttctgtaaggttaccttgtcatcgtctccataccatctgaatgataatttcataaaatgcctcctttgcaattcaataataggggttttcttttcctgacttatgattccagtatatacaaaacaaaggagtattaccatggatttatttgccgttcacattgcaaaacttgcggttatattctataatgtaacttatctgaacttgctacgcaagtgaggataaaaggggcgttctttgccccgtccatccgattatgaaaacagccttttgttttcataatatagttatctgatcttgctacgcaagtgaggataaaaggggcgttctttgccccgtccatccgattatgaaaacagccttttgttttcataatatcattgaggcattagaataacgggaaagaggattttcaaatgaaaaaggaattgtctaccggctttaatgagcggcagtatatgaattcaggagaatttgaagtgtttttttacaaggatctggacctggatcatgtggtcgaccacagccattcttattatgaagtgtattttttcttaaacggggacgtgtcctatgaggtagaagggacccagtaccttttgcagtacggggattatctgctgattccacctgaggtgaagcaccatcccatttttcattccactgggaaaacctatcagcgaattgttctatggatcagccggtactattatgaaaccatgtgttcctggtcagaagatttctcttacagcttccgctatgtgtcggaaagtaagcactaccacttccgcacagattttgtcacattccagaacatccaggggcgccttctggatttgctggaggagatccacggaaataaggcattccatcagctgaatgcacagctgcagattcattcctttatgctgctgttaaaccggatcacttacgacatgctccatcaggtccccgctgcctatgaaaatgtgctttatctgaatatttgtgattatattaacaaccatttggaggaaaatctctctcttgaccatctggcatcctttttctatgccagcaaatatcacatttcccacgtgtttaaggacaatatgggaatttcccttcaccagtacatcttaaaaaaacggcttcaggcaagtaaaaacgggatcctctccggcctcccctttggggaattgtaccatcaatacggtttttcggattataccagcttttacagggcctttaaaaaagaattcggcctttctcccaaagaattccgggagcaggccgtacttccaaaaggatactgattccgcctctttttgttttagcggaagactccctgaatgagaaccatgtagagagccgttcccacgccaatacttaacagggaatttcccttccacaaatgaagggcagcaatagccacgatggcaagaagctccggaagtccatgaggataggaaagaaattgaagccctcttaagcagtaaaccaccaaaagaccaatggtggcatatggaagggtttttcccagataaaggatgtatttcggtgtctttttccctgccggaaacaataagaagggaagaaaacgggtgatcacggtagccagcaccatgaccgctgcaagaaggccgttggctgctatattctggttcaagactgttcctcctttttcttttccataaaatatccggctgtaatgattgtcagaatgaggatcatggccggaacgatgaaaacactctgtccaaggaccgccacacaaagggctgaggcacatacgcccacacaggcggacgggcgcccctttcctgatttccactggtcaataaagatcaccacaaaaagagctgtcagggcaaagtccattcctgccgtattaaagcttatcatggtccctgcaaaagcgcctgccactgctcctgtcacccagtacagctgatccaggatggatacgaaaaaataaacccagtattttgaaatgccctcaggcacctcctcattacacaggacggaaaacgtttcatccgttaaagcaaatatgagatatggcttcagttttcccgcatccttatatttgtccagcatggaaagcccataaaataaatgcctggcattgagcattaaggacataaaaaaagcgtaccacggattcactgccgccacaaaaaatgtgattccaagatactgcaggcttcccgcatagacaaacacgctgataaccagcgcccaccagatcccatatccgttgacattcattagtattccatatgctgcccctaaaaccagataaccggccagcacaggcattgttttgggaaatgcatatcgaagggcagccagtttttttgtttcactcatcctaatcgttcctttgtacgtcatctttgtcttgcattttttaagtatattgtttactatattaatgcacaaaagtgactttgtcaacgatgagaaacaggagttaagcacatgaatcttgatcatatatatgaatcctgctgcctctgccccagaaactgcagggtaaaccgccatataaacaccggcttttgcggatgcggtgctaccataaaggcggcccgtgccgcactccatcactgggaggagccctgtatcagcggaagcaggggaagcggcaccgtatttttttccggctgtactcttggctgctgtttttgccagaattattccatcagtcaggagaatttcggaaaagaaattacaaacgaagagctttcccatatctttttacggcttcaggaggaaggcgcccacaatattaacctggtcactgccacccagtatcttccctccattttaaaagccctggatcttgtaaagtccaaacttaccataccggtggtctataactgcggcggctatgagtcggaagagatcgtaaaagaactggcttcctatgtggatgtttggcttcctgatttaaaatatttcagctctgagctttcctcccgctacagcaaggctcccgattattttgctgcggcttcaaaggctgtaaagcagatgatccgacagactggagctccccgttttgatacccacggaaacattatgaaaaagggagtcatcatacgccatatggtgcttccaggcgcaaaggatgattccatccgccttcttcaatggatgaaggaggaactgccggagggaatgtattacatcagtcttatgagccaatataccccattctatcaaagtggaagctttccggaaatcaaccggagaatcacttcttatgaatacggaaaagtggtggatgaagccatcagacttggactggatcagggatttatgcaggaaaaaagcagcgcaaaagaagaatacacgccgccatttgatttagaaggaattcattaataaaaacacagatagaaacggataccgattttcatttacctgccatcgatacccgtttctatattatctcatccattggtcttgatacctcatttctctctcatgtctgttccttgtacatggtacacgtctttaacatgatctatattaatttttccgctctccgttgctatacaccagatccatggactactttccatctcttaactgttatctctcttgccgtgtcccaaaatttactttgttcgacctctggaatctcatacagtttttccttgccatgaattcaatctttttcgttaatcattctttatgatcatgctttatagattggcttttaacatcggcagattggttttccttttgcttcatctattatttatataaatgaagcgaaactgctctttctggtggagtgtacctcctttcgttaaattttgttaccttttgtatttctctttgttatggcttcattatagcgtacaagctttgttttgtcaatactatttttcattattttacatattaattgttaattttcaaattgtatataattaattagaatatatatttatttttccagcgttgttttaaaatatttttttgcttttattcgaaaattatatacttttgatgtgtttttgtaaaaaaaaacagaaccatttttataagacccattgtaaattccggcataaaatgccatggaatttaactacatggtatctgattcaaggccagctccataagcagattgccctcatcagtccggccgaaagaccacctgcacgctgccgcttccaagtgcatcaaccaagcctgttatatcttcagtacagccaatccttgtatagctataggaagtagggaaactttcatagaacagaaccaggcagtcaggaccgtacagcatgatatcacctgctttgatatcttccacacgctcttccgaaacagggaattcttccgaaaaataatagtatttttcatttccattcagttcatccatggttaaggaaaggggcagcctttccagcaatgcatgagctgaggcattgtcataaagatcagctgtaaaacttttatctccaatttgaatggttatctccggcccttcccggaaatctttactttgcagggaaggaccttccggaagggtgtaaaaacctccggcaaaaatgatcatgcagactgccgacagcaatacaaaaattgttttttgcattttgttctccctttcatctctgaatttaaagggcctttcccatctcataggcttccccaagtgcaggattatcctgtatgtccccggtataagtcacgtttaagccacgcaccacgccctttagttttgctttatcaaagcagttgatccagccctcaagacccctgtccgctcatttcgtaaaaataaatcggcgttgcaaacgcgactcctcctttatgtcaatattcctgagaacctttgcaggaacacctcccacaatggtatttgcaggaacatcctttgtcactaccgctccggcggcaatgaccgctccgtctccgatcgtcactccgggaaggaccgttgcgttggagccgatccacacattttctccaattacaatgggcgccggatgcagggtgctccgcttcttgggcgcaagatcgtgattaagggttgccatcaccacattatgcccgatcagtgcaccgtctccaatggaaatgcctccctgatcctgaaacctgcagccagaattgataaagacattttttcctatggtgatgttcttcccgcaatcagaggtaaagggagggaacatggtaaaagattcgtccaccggctttccggtcagtcttgatattaagctgcggatttcctccggcgtgcggtaggcgctgtttagctccgccgtaattttcatcgcttcattgctcacatgatgcatataaagatgggcctccgatccgccggcaacgggacgtccgcaattcatatgttctaaaaattcatgtaattccatttgatatctcccttctcctctcaagtctgctttgggttttattataaaatgaaatatatggaatagcaaatacttataaagaatacgcttccatagtttacaggaatacttaaaaggattatactattaccatactattattaaaatgcactgggaggaaggaattgatggagctacgggttttacgttattttctgacagtagtaagagaaaaaaacattacaggagcggcgaaagccctgaatgtcacacagcccaccctttcaaaacaactgatggaattggaagagagcctgggtaagaaactgttcgtccggggtaatcgtacgatcacattaacagaagaaggaatgctgctttacagacgggcacaggagatcattgatttagcagataaaacagaatcagaattcaggggaagtgatgaagtcatcagcggggatatctgcatcggcggcgctgaaacagatgccatgcgtctcacagccaaaacaataaaaaaactgcagaacgaatatccccatatccagtatcatctgttcagtggaaatgccgatgatgtaacggaacgccttgataaaggcttactggacttcggcattctcatcgaaccggctgatattaaaaaatatgattatctccggctcccggcaacggacacatggggcttgctgatgaaaaaggacagtcctctggctgccttagaaatgatcaggcctgaaaatctgcggaacatcccactgctctgctccaaacagacccttgtgaaaaatgaaatatcaggatggcttcgggatgattatgataagctgaatattgttgcgacctataatctgatttacaatgcctcactcatggtagaggaaggggtgggatatgccctgtgcctggacaagctggtaaacacaaccggctccagcagcctttgtttcaggccattggagccgggattggaagccaatctggacatcgtatggaaaaaatatcaggtattttcaaaagctgctgaaaaattcttagaaaaactccaagaggaaattaacgccgtctcttagtatgtacactttatttacgcgtctttcagtcctctctcaaacggaagccttgtaccagttcacgcaaaagctgcgcctgctgggataattcctcactggaagccgcactctcttctgcggcggcagcattgttctggactacggatgaaatccttccaagctccattgtcacctcttctacggattttgcttcctgagatgcgatggaggagatggagtccaccgaatccactgccagagcagaatcctccaaaaccttcatcatggactgaacagtttcatctaatatctcattgcccttttccacggcatttatggagtccctgatcagtgccgtggtattctttgctgcctctgagcttttcgcagccagattccggacttcaccggcaaccactgcgaatcctcttccggactctcctgcccttgcagcctcaattgccgcatttaaagccaggatattggtctggaatgcaatatcttcaattaccttaatgatttttccgatctccccggaggaagcatgaatctcattcatggcactggaaagattctgcatggacatgtcgcagcttaccacctcagttccggtttgctggacctgtaaggaaacttctcccgccttttcagccagacgcctgaccttttccgcaacctggctgatggagccggccagcatttcaacggtcttttcctgctcctccgcaccgtttgccagcagctgggagccgcttgcaacctgtccggagcttaccgccacctgggcggcagcctgattgacttcattcattacggaattcaaattcatgacaatctgctttactgctgtttcaagctgggaaaagtctcccttaaggcccagctccacattaaagtccagatggttgtccgcaacctccctaagagcaaaggatatgcggtcgattacctcttttaagtttactgtcatccgttcaaaggaagcggccacaagaccgatttcatcgttggattccacgtcaactaaaacacctaaatctccttctgcgatcttgccggcagctgccacgatcttatggatgggttttaactgcctgcttatgacaaatgttataatgaaaagaataatgatcatggcaatgatggaaataacggtcattaaggtggacatccggtctgcttcatggttcatatcaccggcttccaccgctgtaacggaataccagctggaaccgttcagatgaatgggctcaaagaaataatatgtatcccctttcctggctgaatcaacggtataaaaatcggaaccggaagcaattccctcctctatcccctccttgcacgctccgctttccacaaaatcagaaacattggtgcccacaagcccgctgcctgtgctttcagaaataatggttcccgattcatttaaaataaaggtctgcatgcttggataagaggaacctgccgtcttcatctggctgaaacggtccagacttacatcaactgccaccacgcacaaaaccctgtcattaacaatcacgggcattgccatggtaatgatcttcattccattggattcgtagggcagcgtaatgacctgggccttttgctccatcacctttacaaaataatccgtggcagaataatcctcatacagtccgcagtccttgaccgccccatccttgcctgcatacaggccatagctccgggccgcagagctcatggcatactgttcgaacaggatgcccactcctacaatatcttcggagtagagaacagaggacttgatggtcgtcagcatatagtcctccatcttcataccgtagctgtccattgtaacattatcaaatacctggctcttataaagcggctcggccgaagggcctgacttgatccgcagcccctggagaacctttctgtttgctgctgaattctcaagataatacgtaatattgtccgatacctgacttgcttcgtccagcgtctgctggatcacctttccgttctccgatgccagggtctttaactccctgaaagcggactgtttcattgcattccttgtcatccttgaggtcgtcccgatcaaagcagcgaaaaccaccaccagcataactcctgcaatacatgcgatcttagttgaaagatgatgttttcctatccccttcttctttaaccaagattttcctttgtcccctgaaccacgaatcctccattttctgaaaaactgttccttcatagcataatccccctccgtaagttacaagctttatgggaattataccatattttaccaaaatgtaaaacatcatttgtattttttttggaacatatttacaatttttaaatctgtaaccaacaaacctccaatttagcctttctggaccgcagcagaatcaaatcctgcgatcttcatgaactcttctcccgttatagtttcccgttccagaagatattcggcgatctcatgaagccgcttctcatgatccttaagaatctttaaggccttctgatgctgctcttttacgattgtaattacggcctcatcgatccgtttcgcggtttcaggggaacaggcaagagcggtgtctccgcccagatactgattggttacagtttcaagggcaaccatatcaaattcatcgctcatgccgtaacgtgtaaccatggctctggctatcctggtggcctgctcaatgtcattggcagccccgctggtgactgtgttaaataccagttcttcagccgcccttccaccggtaaaggtggcgatcttacttaaggcagcctcttttgttaaaaggtaacgttcttcctcatctacctgcatggtatatccgagagcgcctgaggtccttggaataatggtgatcttgtggaccggtgcggaattattctgacaggcagcgaccagcgcatgccccacctcatgataagcaatgatctttctttccctgccgcttacagaagagtcctttttctggtatccggcgatcaccacctctacgctttcctctaaatctctctgggtcacggtctttctgcccagacggactgcccgaagggctgcttcattgacgatattggcaagctctgcaccgctggacccggcagtagcaagggccaccccgcgaaaatccacatcatcagagagttttacattttttccgtgtacctttaatatggcctcccgtccgtttaagtcgggaagctccacaggaatcctgcggtcaaaacgacccggtcttaacagagccttatccagggaatccggacggttggtggctgccaatataacgacgccttttcttccgtcaaatccatccatttcagccaaaagctgatttaaggtctgttcccgctcgtcgtttcctgtaaagccgcctccgtcacgtttcttgcctatggtatcaatttcatcgatgaatacgatacagggcgctttttcactggcctgcttaaataaatccctgacctttgcagctcccatgcccacaaacatttccacaaattccgaacctgatatggaaaagaacggtacatgagcttctcctgccactgccctggcgagcagtgtcttaccggttccgggagggcctaccaacaaggctccctttggaagggaggccccgatatccgcatatttctgaggattatgaagaaaatccacgatctcctttaaagcttcttttgcttcctcctgtccggccacatcccggaaggtctttcctgtttcagattccgcatagattttggggctggattttccaaaggtcatggcattgccgccgcccatcctcttttgcatctgtcctgataaaaaatttcccaggaacacaaagatcaaaatgggaatgatccaggtgagcaaaaaggaaaacacaggggacatttgttccacaatggtcttttcaaaagaaacgtcatgggcaatgagcctttcagtcaatgtatcatcgggccataaaccggtcttatacacatcgtatacaggcttgccttcccaatccttttttccggtatcagatttaaactgaatctctgtttccgtctttgccactgcctggaccttcccctggtccaccatttccagaaacgtgctgtaagggacctctgtcacggtttttgactgaagccagggaaccgtcatagcattaaatattatcatgaccaacaggacaatgacataataataaataaatgatttttttggattcttttgcgaattactgtcatctttcaaacccatattactcctccttttattcttccgttactccctgagaattgattttacaaattcctctgcgtccttaaaatcctgctcgttgggatgcagcatcccatcttcatatgcggctattaaggtcctgatctggggagtatcatgaatcgcctgcatctgcctgtacttttcaagaatctggggagccatctttcctccgcacataaagcagccaagatactcattatcatctggcagaaaaacagccacctgtttttccacttgtttataatattctttatttccggaaagcccgcaggttccaaacagagccacccgtttgccatgtaaatcggaaagaaagtccagcacttctgtcttgcaggttccacgattgttccagaaccctacaaaatacgtatccgcttcctctccatgaagctcctccaggctgacaatatccttggattttccgggaagtgtttcaaaaattttcatagctaccttctgggtatttccagttttgcttgtatacacaactaaatagtccatacattcagcctcctatgagattaaaatataccaaactcggttatttatcaatagattccgtaaaatgttaatacaatttatgtaacttttagaatctatatggcaaagtttatgaacatcaggcataaatttgagatggaattatttttcaattttagtttgtaaacaccgcgctccgcttcatggaacaccaattagatgtgcaggcatatccgcttgctttgcctgtatacgaaaatgaaaaagctttggaaccactgtttttcagtcattccaaagccttatttttgttgttttaaaaaagaatcccagccccttcttttatgatgccgcaggttttttcaatatcttcatctttatgagccgcagacagaaacaggatttcaaactgggatggagccgtataaatgccatgctctaacagataatgaaaaaatttgccatatttgaccgtatcagaagccagggcagtatcataatcaactaccggattttttgtaaaaaatacgctgaaaagagagcctgcctgattcacccaggtttccggaagggcttccctcaaggcttttacaagtcttcccgccttttcttccagggaaggataaatttccggccgctccatcagggtcctgatggtggcaattccggcagctgttgcaatgggattgccggaaagagtaccggcctggtaaacctttcccaaaggagaaaccacttccatgatctcctttttccctccgtacactcccatgggcataccgcctcctgcaatctttcccaaagttgtcaagtcgggaacaacgccataatatccttgtgctcctcccagccccaatcgaaaaccggtaatgacctcgtcaaaaatgagaagcgctccgtattttaatgtgatttcccttaaaaattccaggaaacctggttttggcggtacaagtcccatattggctgcaaccggctccaccaccagtgccccaatgtcatctggaaattccgcaaacagtttttttacggaatcttcatcattatattgggcaagcagggtgtgttctgtataggaggccggtactccggcactgtccggtgcggaacctgtcaaagccccggaaccggcctttaccaaaaggccgtcggaatggccatggtagcagcccttgaatttgatgatcttatcctttcccgtatatcctcttgccgcacggattgcactcataacagcctctgttcctgagctgaccatccgcatcatttccatcgaagggatacactccctgataagggttccaagcaacagctcttttctggtaggcgctccaaaggataagccgtcaaggcaggcctctctcaccgcttccactactggcccgcagccatgtccaagaatgcagggcccccaggaattcacataatcaatgtattcgtttccatcctcatcataaatacgggagcctgacgcccgctttacaaagaccggggttcctccaacggaaccaaacccacgtaccggactgttgactccgcccggaaaatactcccttgattttacaaataatgccttggattcttctattttcattttgactgactccttttctctttccaatccacttcgctgcctgattcggttaaatataattatttaatgcccagacgcatacggtaacaaaagtccgcctccatcacctcaccggcaaacaaacattgtattgtctcaacatattcatccagggcactctcaatcagatatggtttatgctggatgatactctggagtccgctttggcttaatgtcatattaataaatcgttttgcatcacacagctccctgtttgcaaaaacaatttctctttgatgccgaaagtaaccgctgtcttttatatgggaaagatgtttatttttatcccatcttataaaacgatctttcaaatccacatattcttcctccaggcagctgactttataaaacaactgcttgtgggcaacctctgcttcccatttgcagaccggcggccagtcgtaatcgacagcagcaaatatgccgccggtctttaaaattcggtttacttctgaaagagttaattcaggattcatccaatgaaaagactgggaacatataacaacatcggcgcaatttccgctcagtcctgtctcatgggcaaaagcctttttaaacgaaattccactatccgcttttttactggcagccaggaacatctcatcgcctggttcaataccgataacagcgttgcaatggtttttccatacaatagttgacaggcccgaaccgcagcctaaatcaactacaacatctgctcttttatttaaatattttgttatgatttcgatcggatattctggcattcccggtcttgcctgatcatagacatccacaaatcctaaaaagcgatttttattctttattgatgcatccaatcgatcacctcctttttatataaacaattaccacttcaatcagccataatttcctatttccaatcccggcagatggcttccgctattccctggatgctgcagaccccggcaatgatatccgccttcctcccatgatccataagagcttttgctgtaatgtccccgatacagaccactttgaggcctgccagggcttcccttgtttcctcatctgcctcccggaaaaaagcttccacaccggaagcgcttgaaaaggtcagatagtccaaattctttaaggcttcggtcctgttttccgcctttaagcctgccagggccacatcatagagcacgatgtcatcataagagcccccggtttcatcaagaatctcattcaattccttagagcctctaaaggatctggggatgagaagcctgtcctccccggaaattaagccttttaaaccaacggccagatcctgcacctgatatttctccggtatgtaatccgcagaaaaaccgtaccgcagcaattcatcggctgttccctttccaaccgcggcaaatttcacatgcccaaccgcccggaaatcatacccccattccagaagcccccggaaaaattcccgcactccattggcactggtaaatacgatccaggtataggattgcagcttttcatatgcttccttcattttctctcccttccggcgggactggatcaaaaggccgagaatacattccgatacccctccaagggattccagctgttttctcagcctgaccgtaaaggaacctgttcctgtcactccgatccggcacccctccaggggctgttttaacgtagaagaaaaatcaagggaagccacctctcccaccacaataatcgcaggactttctattccggccgccagcgccctttcctcaatattctttaaagtcccgcgaaggaccctttgtccgggaagggttccgctttcaatgactgcagccggggtttccgaccctttcccctgctttaaaagtcctttgacgatgagagacagatttccaaggcccatgagaaaaaccaaggtaccggaaagcctggcaaactcagcaaaatcagcaggaagctccccttcttctgaaagggtgtgtccggtcataacatgaaagctcctgctgaccgcccggtgggtcaccgggatcccggcgcttgcaagggccgccaccgcagaggtgactcccgataccacctcataggggatcccggctttagaaagggctataatctcctctccaccccgtccaaacacaaagggatcaccgccctttagccttacaacagaaaggccctcccttgccagctccaccagaagccggttgatctcctcctgcttcatggaatgatgtccggcgcgttttcctacatggattttccggcattgatccggcacctcatcaagaaggcggggagaagcaagggaatcataaaccactgcatcgcatatccgcagccttgacaatcccttttccgtaataaaccccggatctccgggaccggcccctaccagatagacggctcctgttttcttcatagcatcctccttttttacgaaaggccttcggctgccagccgcgccagctcatccagttcccctgatcctccccgcagatggatccgctttatctcttcccctctcctgctgattcctaagacttccacttctttgcctttgaccctggaatacacgccgataggctcatggcatccggcattcagcagctttaagatcttccgttccaaggcaaggcacatcctggcttcctcatcttcaagaggctttaccactgcctcaaggcccgattccagccgtccttccacagcaagtattccctggcccccggccggaataaaggactcacagtcaaagcagtggtaatcgtaacggctgtcctcccaaagccccagccgttttaatccggcagcagccagaatgatgccgtcaaaagagccttccatgagctttgaaagcctggtggtcacattaccccttaaattttcgcagcgcaccaaagcttccggccacatggtctttcccatttcctctatctggagctttcttcttaagctggaagtgccgatgacgatttcctttttcccagaaaggccgctggaagcaggtgtcaccagtacatctctgggatctcctctttccaatacagccacaatccccaggccctcctccagctccatgggaagatccttggcgctgtggaccgcaaaatcgatttctccctgcagaagggcctgctcaaattccgccacaaacacgccttttcctccaaattccagaaggggcttatcaaggatcctgtcccttccgtctgctttagcaccagttctgccggaaggccggtacctgcttttgcaagggcctccaccaccaggtttgcctgggccacagctaaagcgcttcttcttgttccgatgcgaataatcttatttttcatgctccgccagcttcctttctatcagttcttctgcctgttctctggtaaagcctccctgacggattccttcttctgccatggctttgaatattgaccttctgacaggctgggaatcgaccctttccctgaccatgtcccggtatgagccaagctgctttgccaggcagccagatcctttgggaatgacgtttttaaacttattttttaaataccgggcaaggaccggagaatttcctcccgtggatattcccaccgtgatatcctcatccttaatgagtgccgggaaaataaaactgcattcttcctgcacatccgccacattgaccggaatcttccgctccctgcaccagatggatatctgcctgtttaactctgcatctgaggttccggctatcacaaaatccgaatcatccaaatctgattcttcaaatttccggcatttccatgtgagccttccccgcttttctttgcaagctcctccatcttaagacttacccggggagccacgaccactatatccgggccatactccatcaatgccgcggccttccggaaagcgaccgctcctcccctgctatgaggcatttttttccttcaatatcaacaaaaaacgggaaataggccacgtcatccctccttaatccagtgttccaggccatccagagttttaagcaccaccttcagctcctcgctggaaacgtggtccctgacctcatacaaaagcgtgtccagaggttttccggaaaatacttcccgaagctctttcattctccggatatatggatggaataacacttctttaatggccccatccagttcctcttccatgatcacctttgccctgtccagttcctttagctttatttccgtgttattctttgaaagtgtttcaaaataatcaatatcgtaaagggtcagcccttccatttccccgatctccgggtccatatccacaggaactgccacatctatgaacagccgtttttttcccggattcacctgttccgacaattctttacatgttacggtataatgaggccccagggtggcactgatgacaatatccatttcatccatgtactgatagcggtccttgtaatccacgacccgcacccggtcctctttcacctccagcatcaaaccggaattatggcttctgaccgtgccggtgacctggatgccaggcttgcttaaaatattttttgttatggtattgcccatcttgccggtcataccgatcaccatcacatgcttatccccgtcttctttttcaaagcggaatacctcattggccacaagggtcgcaacggaaagaggtgttctggataaattggtatccgtcttgatccgtttggcacaggtcaccgccctttggaacagcacattcatttcataatccgccgatccctgatccttagaagcctgataagcctcctttacctgccctaaaatctcatcctctcccaaaaccatggaatcaaatccgcaggctaccttaaacagatgtccgatggcgctttccccgctgtaaatatttaagtatttcagcagctcctccaggcggatccccttaaaatcagccgcctcccgctgcagttctcccatggcctgctttgttcctgaaacgtaaatctcactgcggttgcaggtacaaagtacgaccacaccggtcaccgcttccttcttcatcagccgtttcataaattctgtcttttctttttcactgaaggcaaaccgttcccggatattcacagaggcctttttatggcttacactcatacaatacatctttattccagctttcttatggtaaaatcagttattaaaaactcctacttattctaacattccataaagaaaagagcaaccagtcattccaggatatatgagattaaacacttaccatttccaaaacttttcttaaatcacatgttaaagcccgttgaatttatggcatggaaaatgctccctcccaggcaaacaagctttattatttcacttgtcagcctggaaaggagcatatcagaatccggcaataacatcatttctgcttcttattcaaaagggaaacgatactgggtgagtcccaattcatccctgattttaataagctctttctgtactgcctcattgatcggcactccgctgtttttacgctccagccataccaggtattccttctcacctgccgtataaatgcggtcttctccaggtgctttgacagagccgcgaagatcccggagaatatcgccgcaggtctttttaaaggaatccaggcccataaaggcttccgtatcaatggcaataaagaagtggcctaagtggaagggaaccttttctccttcttctccaatgccggttaaggctcttaagaaatttccctgctgcaaagcagcggaaagaatttcaaccacagtggcatagccgtatcccttgtagcctgccagttcttcaccgattccgcccagaggtgcaagggccgctttacctgtattcaagtcagcgaggatctggtctgaatccgtctggggctgcccgtcccgcccgattaccataccggaaggagtggatttgccgatacgggaatagtattcgattttgcctctttgggtaatggaagtagcacagtccagcacaaaggggaattcctcatcagtaggcattccaaaggtaagaggattggttcccagcatgttttccacaccaaaggtaggagcaatggaaggccttgcgttggttcctgtaataccgatacaccctgcctgggaagccatggtcgcatagtagcctgcaatgccgtagtgggtggaattgcgggcaaccaccatgcccatgccgtattctttggccttctcaatggccatattcatggattttacaccgattacctgacccatgccgtcgtgtccgtccacaaccgccgtagtttttgtttcctttactacttcaaaatttgtgaccggattctggattcccgctttgatgcggtccagatatatgggcttaaaacgattgactccatgagattcaattccccgcttgtcagactccagcaatacatctgcacagattttcgcgtcttcttccggaatcccataccccttgaacgcctccaccacaaaatctgtaattgtcttccaatccacaatgtttgttttgcttcccataaaatacctcctgtatttttaatatttatttaaagcattggctcccgtaagacaaaaacctctgcccccgaccttttatatttataatttatcataaaacagagaagagtggaatcattgacaaatattaaacacattttgtaagtaaaaaaaacggaccggtatttcttactttcataattcattctttactttcctattcttcttttttcgattggattttcctataatgagtcaagcggatattggcaatccgcttgacacttgatttggctaaaaaataaaaaggagaaggagattttttatggcaaactatgtaatggcattggatgcgggcacaacaagtaaccggtgtattctgttcaatgaaaaaggggaaatctgcagtgttgctcaaaaggaattcacccagtattttccaaaaccaggctgggtagagcacgatgcaaatgagatttggtccacgcaattgggggttgcagtggaagccatgtccaaaataggagcttctgcagaagatatttctgcaatcggcattaccaaccagagggaaaccacgattgtatgggataaagaaacaggtgatcccgtctatcacgcaatcgtatggcaatgccgcagaacttctgaatactgtgactccttaaaagaaaaggggttggtcggcaccttccgttccaaaaccggcctggtcattgacgcttatttttccgctacaaaattaaaatggatcctggacaacgtagagggagtaagagaacgggccgaaagaggagaactcctattcggaaccgtagaaacatggctgatctggaagctgacaaaaggacgggttcacgtaaccgattactccaacgcttcccggaccatgatgtttaatatcaataccttagagtgggacaatgacatcctttcagaacttgacattccaggttccctgcttccccaggtaaagccttcaagctgtatatacggagaatcggaatctcaattctttggcggccctattccggtcagcggcgctgctggggaccagcaggcagcacttttcgggcagacctgctttacccccggtgaagctaaaaatacatatggaaccggatgcttcttgctgatgaatacaggagaaaagcctgttttctccagcaacggcctggtgactaccattgcctgggggctggatggaaaagttgaatatgccctggagggctccatctttgtagcaggagccgcagtccagtggcttcgggatgaactgaaattcattgattccgctcaggattccgaatatatggcccgcaaggtaaaggacaccaacggatgttacgtcgttcctgcttttacaggactgggagctccccactgggatcagtacgccagaggcactgtggtgggaattacccggggagtaaacaagtaccacatcatccgagccaccttagattccctggcctatcaggtaaatgacgtgctccaggcaatgaggtcggattccggaatcaagctggcatcacttaaggttgacggaggcgccagtgccaacaattatctcatgcagacacaggcagatatcataaacgcacctgtaaaccgtcctcaatgcgtggagactactgctatgggagctgcctatctggcaggtctggcagtgggatattgggcaaataaggaagaggtcataaagaactgggccattgacagaacctttgaacctggtatcagcggggaagaacgggcaaaaagaatcagcggctggaacagggctgtgaaatattcctttgattgggcaaaagaaaattaaaaaatgaattaaaagatttggggaggaaatgtatgttaatatatttagcagaattcttaggaactatgattatgattttgcttggagaaggcgtggtcgccaatgttaacctggataagaccggtatgaagggagctggccccgtccagatcaccattgcatgggggctggctgttatgattcccgcatttatctttggagcagcttccggttctcattttaatccggctattaccattgccctggctgcagacggaagccttccatgggaccttgttccgggatatgtgaccgcacagtttgcgggagcatttgccggtgctgtcctggtttatttactgtttaaagatcagtttgacgcaacggaaaaccaggccactaaattgggagtgttctgcacttcgcctgcgattcccaacaaagcccgcaaccttttaagcgaaaccatcgggacctttgtcctggtatttgccattaaaggcatcggacaggcaggagatgttcctgcgggagtcaataaccttctggtgtttggaatcatcgtttccatcggtatgtcccttggaggcttaaccggatacgccatcaatcctgccagagacttaggcccccgccttgctcacgcagttcttcccatcaaggataaaggcagttccaactggagctatgctcctattgtgattttcggccccctggccggcgcccttgctgcagttcttctctacagcgcaatcccctgggcataacttttccttacaatcctgcaaaagtgaccattaaaaaacaggaaagcgccggaacacttacacagtgtttccggcgcttttctcactctgccaggctgtcttcttccattatgtagtgatagacaacaccaggccttcctcctgtattataatcaatgtcactgactaccctctgtttttccagcagatagttcatgtaccttctgaccgtcacactggacagctggacagctttggcgattttttcgcttgtcattggatttggctggtgcattttcatataatccaatatgctgtttaaagtagcttcctggattcccttgctgccttcttctgcctggagcagagaagaaaagtgaaaaagcttatccagctgggactgggagaaattgcggggcttcagcagttcctggttttttgtgaacttttccaaagcatggttaaatctggtatattcaaatggttttatcagataatcaataattccaagagaaagaaacttcttcacatgcttcacatcattgacggaacttactactatgacatccagatccttctcctgtctccgaatctcccgtaaaagttccattccatccattttcggcatatacagttccgtaatggccaaatccacggaatgcccctccagatagttaagagcatcctgtccgttggaaaaacaaccacacacttccatatctttgtttaattccacatagtggcgattaatagaagcaacgatagggtcatcttctatgatgattgtttgatacatgatttttaacccccctgtaaaataatggtatcaaataagatcccttttttctgcccacaaaaaaaagcgcacccaaaagacaaccttttagttgtcccactgtgctctctctttctctccggaccgatataaaactattataacataccatttccgctatttcaataaccaatccggccgaagatcatatcctgcaatccctttggtatttactcccggctgtatttgcatatccttcattcatcctatataatggaatgcactggcaaaacataaacaggaggccaaacaatgactataagaccggtaagaacagacgattcccgaaattttttagatatgctgaaacaacttgataaggaaacaagctttatgatgcttgagccaggtgaacggaccaccacggttgaggacatggaagcaaatatcagaagcacagtcacttccggctccctgacattgatccttgaggatgaggaacgcattgcaggctttttatccgcctcaagaggttctgcggccagaatcaggcacagggcttatattgtgatcgggatattaaaggattacagaggaatgggattgggagaaaagctttttgaagagctggaaaaatgggcgcaggaacatcatgtcacaagactggaattaacggtaatgacccataatgaagcagcaatacacttatatgagaaaatgggatttcagatcgaagggacaaagaaaaaatccctgctggtaaacgggatctatgttgatgaatactatatgggcagaatcctttaaatgcccataaatatacagcgccctggtcactataaagtcaccggggcgctgtagtgttaaagcaccttgcttaaaaacagcttcagtctgtcattttgagggttggtaaagaattcattcggttcgttttcctccaggaaataaccgccgtccataaacatgacccgggtcgccacttctttggcaaagcccatttcatgagtgaccaccaccatggtcatccgttcctcggccagtccccgcataacattcaacacctctcctaccatctcaggatcaagagctgaagttggttcgtcaaacagcatcacatccggattcatgcacagggcacggacaatggcaattcgctgcttctgacctccggaaagctgatttggataggattccgcccggtcggcaagacctactttatgaagcagttccaaggcctgggtctccgcctcctgcttactgcgcccctgaagcttcatgggagcaagggttaaattcttcaaaatggtcatgtggggaaataaattaaactgctggaataccatacccattttctgacggtgcttatcaatgtctgtcttcctgtccacaatgtccacgccttcaaacaggatatgtccccctgtaggctcctccagacggtttaagcagcggagaaacgtactttttccggaaccggaaggcccgatgacacataccacatctcctttataaatatcaacggatatgtccttaagcacttctgtgtcgccaaatttcttacccagattctgtacctgaatcaggggatcttccattctattaatgctcacttctgtgcagcctcctctccagcaattttacgagatatgaaaataccataaccataaccagataaataacggccactgcaatcagaggcatgaacgcagaataggtacggcttttgatgatatcgccgccctttgtcaaatcctgcagccctatgtatcctgccacagaggtctcttttaacagaacaatgaactcattggcaagagtaggaactacatttttaaaggcctgaggcatgatgatgaaccacatggtctgggcgtaattaaagcccaggctgcggcccgcctcaaactgccctttttctatggaactgattccgctccggaagatttccgccacataggcgccagagttgattccaaatgccaggatggccgtaggcacctgacccggatcagtggatgcaaaaatgacaaaatacatgatcataagctgcaccaccaccggcgtaccgcggatcaccgtcaggtaaacgctgcaaaccccatttaatattttcagcttgccggtattttcataggttgaacgtatgatcgcaaccagaaatcccagtaaaataccgatcaaaactgcaaaaaatgtgatcttcaacgtgttttgcaaaccgccggtaatgtatttccaacggtcatccacgataaaattctgataaaaatcatctcttagcttttccaacatggcactcatcctttttcttattccgcggtgatgtatttatctacgatcttctttaattcaccggattcctttaattccttgatggctccgttcatcttctctaacagctctgcgttgccttttttaatagcaatggcatactcttcttcagtaaatgcctcatcaaggatcactaagcctgtattttccttaacaaacacctttgcaggctcacggtcaatgataaccgcatcaatcttaccctgggtaagcgccataactgcttccattcctttattaaaacgctggatgtccgcactctcaatatcctccgcataaatatctccggtagtaccggtctgtacgccgatcttctttccggtcaaatcatccggtgtcttgatctcgctgccttcttttacaatgatgacctgggctgcttctgcataggtatcggtaaaatcaacgtttttcttacggtcttcattgacggtcataccggctgcagcaaagtctgctttaccggactgaacagccgggatcagggaatcaaaggccatgtcctgaatttccagctccacacccatcttgtcagcgattgcctttgcaatatccgcatcaattccaacgatctggttattatcatgatattcatagggcggaaattccgcgttggtcaccatgaccagctttccggcagcttcatcctggcctgctgcagttgtctctgtctttgttccggaaccggcacaggcagttaataacgctgccatacatacaacccccgcgattgcgattacattctttttcataatgattcctcctcttatatacacaaacatgcataattattgaataaagtatcagttatacattatatagcattttcggaattaatcaagtacttaataagaagaagattcttatttttcccaagtattttcatttatcttgcatgttttcaggcaatcctatataatatggcttaattggaagcatgaaagaaaggtcagtattgatttatgaaggatttcattgtaaaaacagcgtggcccatgaatccgccggccccttattctctgttccacatcatatttattgccataggacttgccgctgtggtttttctggcttattacaccaccagaaaaataaacagttccaggcttccccggctgcttttcttctgcggcctccttcttgctgccaccgaatgctggaaacagctttttttatattatgtggtaaacgaacagacctacaactggtggtattttccatttcagctgtgcagccttcccatgtatttctgcctaatcctgcctctggtcccttctagggacggccaaagagttctctgcacctttatgcaggattttaaccttttaggaggcgtcatggcgctggcagaaccttcaggactgtttcatccttactggtttttaacccttcacggcctggtctggcacctgcttttgatttatatagggctggcgattgcattctcccggctttccgatacttcgctttttggatttgtgcggacgcttcccctgtttttcgtctgctgtatcattgcttctattattaaccggacagcaaagcctttgggtcaggcggatatgttctatatttcgccttattacccgtcggcccagatcgtttttcatgaaattgcgttaaagtacggaatatccgcaggaaatgcagtctatctgtttgcaacctgtctgggaggattcctgtttcacataatattcagtaaatttcgcttactctccgccaggaccgaagcttaggcagcaattcaatcaataccatgatttcaggaggaacatagcatgtcagatacaacatcgaaaagagtggaagaagcatttaacaaacatgcaaaaggatataattgtgcacaggctgtctcctgtgttttctgtgataaaacaggaattgacgaagaaaccatgtttcgctttacggagggcatgggccttggtatgggcggcatggaaggtacctgcggtgccatcggggctgctgccgtgctttccgggctaaagaacagctctgcccgccttcataagccggattccaaacggacctcctatgaatcgtctaaaaaatgcctgtcagattttaaggaacagaacggaagcgtgatctgcaaggatttaaagggtgtggaaaccggaaatatcctccgctcctgcgatgactgcatcgcagatgccgtaaggatcattgaacgggaattatttaatgaagaataagctgaccatggagaaatctccaataagcttaacagagcctattggagatttttattttttatttttcttcttcaattggctgctttctggcagtctttacatctgaaaggaatgtcttccatgcatcctcgtgagccacaaaataccttggacagtcctttcccgtggcatcgtaatgcctgatcacatctttttccgtcaggcccaggttcctgcacagccaggcagtcaggtttaccagagaatcataggtagcatcgttaaattttcctgtctcatcgggatggcagcattcaatggaaaccgtatccacatttttttcctttgatgtggaataggccatttcataaatgggtatcccctgaagaacctcccctccagccctatgataaaatggctgctggcggagattttcttaatccctttctgatcctggaggctgttgaaataattcatgttctgtttggctgtggtccctggattggccacataatgaatcactatttcattgacccggttcatttccgttgttggtcttgaaaaaggattggggtcaagaaaatcctgttggacccattccggcatggaaatcttctttaaatccacataatttcttgcaaacaacaggctcatgatccatatgatccccgctaaaacaacggacagcgcaagaacccaggcccctatgtaaagcatccgctttcttttctgcttctttttcagcttcctccgccggtctctggcacggcggcggcgttccagttcgtcacggctttccattccctgatttttcatgtcttaactcctgattttccatttccttaagtttacgtctttttttatggaaaagtcaacctaaaacatggtatttatctcatgcgtttaagccttatgacccattttcacagtctcacacacatcccggagcacccggtgaagctccccctgtaccgtttcatcgcacaggactacgattttatctcctgcagtaaactttgtctcccctcttggaacaaactcagcctctccccgcattaacgatatcagcaggcaggtcctgggccacctgatttcagaaaccttacggccctcagcctcgcttccatgaaaaatcatgccttccaccagaaccttttctcctgtaagggatgactctttccccgggttcagccttgaaagaaggcggtgaagaagctggtcgtataccggtgcacaatgaaccagatccggaaccacataggctgccagggacaccatggacaaggtcagcaaatgggaaaaggagccggtcatctcactgatcagaataatgccggtaataggcgcccggactatagcagaaaaatatccggccattcctaaaataataaagttatccaaaagcccgtctaacgaatgggacaccattccgaccgcagtgaaataaatgcttccgatcacagctccaagcaccaaaagcggaagaaagattcctcccggagcgcccgaaccaaagcttatcatggaaaaaccgaatttcaaaaccaggagcaggcatagagacccaaacatcatctcccctgaagtcaaaacctccaccagggaatgaccgccgcccaatacatagggatagataagaccgaacactccggctgataaaaacggaatcataagccttgtgttctgactggggatcttccggtataaatcctgtgtccctgaaaggcaggtgttatataccacgcccatccctcccatgatcaggcctaaaaggatgacatggccataagtatgcaatggcatcatccgtgtgatctggaagtcaaaaacaggctgcattccaaagacatttttggatacaaaatcggcagtgatggaggaagccatggtggacagcagcacctctggtgagaaatgtttatgaacctcttccagggaaaagagaactcctgcaataggggcattaaaagcagccgaaagccctgcgctggctccgcaggtgataagcagcttttcctctgtcttggccctttttgtcagccgtgagaatcccttggcagccatggagcccagctgaatgcttgggccttcccttcccagggaaaggccgcaccccaatgacagcaaaccgccgcccagcttggctgcaagaaccttccaccagcagggatccagttccccgatcatctccccttccacctggggaattccgcttcctgatataaaagcctcccatttaagcaaaagggccacagcaaatgccgcggctgccaaaaaaataaaccataccggtataaaccagatatgatcctttccgtaatccaaaacagagttcagaattttatccgcatagcttaacagataccggaaaagcacaacaaccgctcctgatatggcccctatgacaatgccttccagtattaatgcatagcgaaaactgcggtaacggtttatggttttctttaccgtgtggccttcagtctccataatattacctcctttaagtcaaataccatgttattcatttacaagtaatcccttgcaaacaatataagattatattcccttaaaatcctgtttgcaaggaaaaaccgcattttttataaaataaaccggtccccgctttctattttaagaagctgggaccggtttattgattttatttgtatctggttttcaagctgcatggcccactagttcttcaggagaaacagccgtattatagcaaataatttctacctgttttccaatgccgataatcataatacccatcagtgactttccgtcaataaccagttgattataaacaactttaacatcacagttacacttttctgcccttaccacaaatgcaaccaattcttctactgtagaaaacgtgtgttttaagtgtctcaccttaagcacccctttgccatgatcctaattattttatctctttttttaacaaaaaacaaacgagcattccagaaaaaataagtactttttcatatacattcctattatttccatagtacaaaagcttatacgggaaaaaacaaaaattttactaaaagtactacccaaaactgtacttttcgtgtataattgtatcgttcgtcttttcttaagagcgaagtatcagataaattggtgcaaaggctggatttctgtggtttttatgcgtttgctccgaaactgaataattattaaatggaagcgtatcgaagtggtcataacgagccgcactcgaaatgcggttgtccgcaagggcacgtgggttcgaatcccaccgcttccgctatgagcctgtttgcggtcaatgttcgcagcaggctcttttctttttctgcgcccctttggggcatttttagtatgcctgtaaaaacgcctggccctgagtcttagcctcttgttctttaattactaataggttcagccgtactatatcaatcagaacttttctctacgcaacatgaaaatcaaaataggtattcgggtacggttcgttaatcagtacataatgccaccattcaaagcgatatgctttaaacccgctgctttccatgatgcagcgcaggcgctcacggttccgggcctccatatccccaattccttttgccgcatggtgggaacgctcgtccataaagtcgaagctgcttcccatgggaacaagggtatccgtatccaggtggtaaagggtaagatccaccgcacttccgcggctatggctggaatgtgatgccacatatccctttgcaatcatctcgcctcgcttaatattcggataatatctttcttttgtgaggtgatcctccggctgtgcggcccagtgaagaaaacagtccaccgcacattttggccggtacccatcccataacagcaaaccgtacccaagcgccgccgcccggcttttggcttcccgcagcgcctgtcctacggcctgagttactacgatgcggtttacttcatatccgtctaccggttttcctgtgaaattatcccatgtggcatacttggcatcccagcggacgccctgcagaatttcatccaaaaaaacaaatcccttttccatggtagtcacctcttttgcgccaattcgatcaggcggtcaatcaattggggaagcgtgatgcctgcggcagccatcatacggggatagcggctgtaggatgtgaatcctggcagggtattgacctcgttcagcacaatgcggccatcctcctgtaaaaacagatcaacacgggcaagacctctgcagcccagtgccccatatatttttttcgcagtttcccgtatccgttcccgaacctctggcggaaggtctgcgggtacggtgagcatcgcgttttcagaacctttttccggctgagcttcctgatgaatgcgaaaaataccgtgccgcagcctgatttgatccacctcgccgacaatcagccgggaaccctctcccaatacggcacagccggcctcacagcccaaaacagcctgctcaactaagatttttgtgtcatattgtcccgccgcttcaattgcagcatccaattcctctgcattattaactttattcacgccaaatgatgaccctgaccgcgcgggcttcacaaaaaccggataggaaaacttatctgctgccggcctgtcgtttttacgaatcatctggaattcaggaacagggattcccgcgtttttcacaaggatgtacgccagtgatttgtccatacaaaccgcggagctttgaatatcacagcccacataggggaggccggataattcaaacaggccctgtattgacccatcctcccccacttgccgtgcaaaaccggaaataccacatcaacaggttgaatttcatatttatggtttctgttcactatcagcccatgcatttctttatccggtgagagtatggcactgcagcagctgagttcttcccattctgtgcacggtttttcgcacagcttccatgcaccggattttgtaattccaatgtatatgggctggtatttttcagtgtcaatgtttgcggcaatctccattgcggattttaccgacacatcatgttcctcggagcagccaccaaacaggattgcaacttttattttattcatctttcaggctcctttcaaaacttaaacagttcttcattgtattgtcaaccgtttcacgcagcatcccttgggtatagtaagccgtgtgaggtgtgattattacatttggcatcctttgcagctgctgcaaaaatggatgattgattggttttagtgagcaatcggagtaaaagatttcctcctctccctccaatacatccaaggccgcccctcccagcattccgcttttcaatgcctccaccagcgcaccggtatctataagcgcgccacgccccgtgttgatcagaaccgcgccccgcttcattttcctaatttgatcacgaccgataatatggcgcgtatcctcgcccagcggtacatgaagtgtgacaatatcgctgctgctcagcagctcataaagtgaaacatagtttccctctgttctttggttggaatcataagccagcacataacagccaaagccctgcagccgttccatcaccgctttcccaatacggcccgtcccaagaacacctacggtcatgtcccgcagctcctttccccgaatgctgttcaggctgaaatcctgtttttccacagaatgtatggtggattttgcgttccgtgctgccatcagcatcagcatcaaggtataatccgcaacgctgtccggcgaatacgccacggtgcccacagagatgcccattctcccggcggcctttatgtcaatatgattgcagccgatgcttcgggttgaaatatacttcactcctgcgtctctcagcgcaagaataacggattcggaaacctcggacttgtgtcccacgctgacgcattgattgccggcagctaatcttgcgttggtttctgataccgcatcacttaccatggtgggggtgatacagagagcaggcgacagccggcggaacatctccgcttcatccggctcgcagccataaacagttatgccaaaattttcagtcatctttttgcctcctgaatttccacgttttccggaaggggtagcagattttacatttgtttgtataaagcagcttttggcctgttactttcccggtatccgcgtcaatttctgctctttcaacttttgcgtattcataaatccctccgctttcacggcaatactgggtgctgccgtttacaactcggtacagcacttggggccgcttatcaacaagcaccatgccgacgatattttcatcatcaaacgtcactgaaatttgataggtgcatttggtatcattccttgccttaagatcaagccatccctcagagatcgttgcgtccacccctttgatttcgtcactgttgggttccggaaactccttgaccttatgtccgctccgctcaacgaccgtcagaggcgtgtgaagaaacatccaaaacaacaaattgctcatttgacacattccaccgcccggcctggtggtgagcttgccgtttatcaccgtaagtccgtctttatagggaatatgcttgtccccattgcgtacaagcctccaaaaagaaaaagtgtcacccggccggatcaaaatgccgtttaatgtatttgccgccagctttaggttaaataccttgttttcttgaaataccatatcaaatccggtattgctgttgtataatgcacaacctgctttaaagagtacataaggaagctgattgttatcaatgatttccgtataatgacagttgtcatattgcattctggcataaaagcacatctttcgctgcatctccctgacaggcaacaggaaaggaaatatttgcgtcactctttttctgctcacaagagcacctccttgcttaattcataaatcccaccgctctcataggatcactcaacactgctgtttgtaactctgtgcagcactcaggccttttgtccatggcaaatcgcctttcagtcttgggtattcaagtattcttcaaggcaaaggttttgctcatacatttctgtggcggccgcaataccaacataacggtaatgccacggctcgttgctgactccagtgagttccgttttatcgggcggatagcggcggataaagccgaaacgataggcgttttcgttcagccacccgtaaacttcatttccagaagaatgaataccgtctgcattaatgtccaccgcaattccgagctgatgttcgctcgtcccaggaacagccacccaggcctccgcctccttttgggcctttgcaggggaataaccctccgcctcataaacggcgattttttcattcatgattttttgctgtttttccgttgttctgtatccggatgcgacaatgggataaactccatctgcccttgcggcatcaaacattttttggagtgcagggtaaatccggatatcaacggattccccattccacagccgctttagttctacgtcgtatccggcggggatgggattccacttgtttaccagaataaggctccactccgcttcatctaaaacttcttttgctgtaccgccggacatttcatccggcttcacattcgcactgctctcgattaacagaggggggtcaagcaaggaatttgtatcacgtgcaggaagttgtctgttccatagcaaaccagcggcagctgccagaacgataaggaacccacatgagacaaacggccttttatgataccgcttcgcccgacgtttatgacgactcagcttacgttcatctgctttttttcccatttgcaaaaaagcctcctttcaaagatacaaatacctatgtgtgccacgattgctattatggcaaacccatctgtatttcccctgtagccagcctgtaatttgtctgtagcggtgagaaaaaagaccggcagggataaccctgccggtctaagcgatggattgttttatttggtaagagtgtcttgcttttctgtcctcaaattcattttctccttatggcagctcatgcttttggcaagtccatccaaaacagaactccatccggggtattttctaaagcaaaattgatgttcatggcttccagtgttttccgcacaatggtcagtcccaggccgctccgtccaatttcccggctccgcgccttatccacgcggtagaacgggtcaaacagcttcggcagaaccccatcgtcaatcctcgctccagtattcattacgcaaaggcggaattgctctgctgcctgttcgccccatatccgaacctcgccccctttgggcgtattctgcaccgcattcaatatgatattggaaattgccttttgaaacattttaggatctataaggcagttaattccggcaggaatatccgtaatgatacgcaagtcgtttgcttccgatataagctgatagtcaggcagcatacccaaaaccgtatctccgatattcagtttttcaggaacaggcgcaattttcccattgttcagacttacgatttcaagtatttctgaaatcgttttgccctgtacgtccatcattctcacacactcgcgaagatatttggggcggtctttgtaatcgcctatattttcaagcatcccctctaacaagacacttgtagccgcgataggcgttttcagctcatgagaagctgccgaaaagaaataccgctgcgtttcttccaactcacgtacacgcaagatttcattttccaattgggatatggtctctttcagtttttcgtacatgaaataaatgtcatgagccaatacaccaagttcgtctttacgctctaccggcggcgggacttcttcaagatttgccattctcccggcgctgtttacaagctgcctgattggtttggtaatttgcttcgcaaaaacgtatgcgcaaaaaaggctgagcgcaagcatcacagcaaatacagcaaatactctaatagctaaatcacgataaagagattctaatcccgtcctgttttgtgcaataacggagaagtccgtatccttatgcacaacaaagaaaaagtcgccgcgaaaattgtctgatgtattagcgtttggtgtggcatatatgggatcgcctttattatccacaacgaggaatacaaacgactggttgttttcatgaaagcgttgtcccattgaagcaatgtcattggtattgcctgtctgaatccgttttaccaaaggttgatatgaagctactatttgacggttctgcaatgttctgtagaacaacataaattgccccgaaaacagtactgccatcacgctgacaagcagcaatacggcaattaccgtgtaggtaaatactttaatgaaaatcccatgctttatcattcagacttcccctccaaccggtaccccacgccacgaactgttttgataatattctccggcagctttgcccgcagatttttgatatgagtgtgcacggtactgccgtcaccatcaaagtcatatccccacacgcgggataatatgatttcgtgagacagagttcggcccttgttctgaatcagcagcaaaagaagttcaaattctttgcgtgtcaatggcagttcctgaccatcatagcttgccccaaaattctccggaaggagaatcagattaccatagcggacttctttttccagcgcaccgctgcgccggagcagagactccacccgtttgagcaaaagctgaattttgaacggtttcgtcacatagtcatccgcttctgcgtcaaaagccataatttgattttcgtcatcagaaagcgcagtcatcatcagaacgggcgtattacttagcttgcgcagctcccgcaaaagctcatgcccatccataccgggcagcataatgtcgagaataacaagctgatatatattgtcatagaatttcccatacgcttcgttcccatctgagcaggcgtctactttatatccggcttcggataaaaaggttttgacggtattgcatatatgctcgtcatcctcgacaagcaggattcgtatagacataaatacattcctccgcaaaaaggataacacagcaatctgtatttttcctgtagttttaagattttgtccgttcagatttcattcgtccgtcagaagcactcccggcaatttggggaacagcccatatggacatctccattgctgacattattatatacgctcaaacaaataatatcaaatcgtcaaagctattattaataacctgttatcatcgtggagaatgggtggctgcatctttcattccgttttgtccttcaccctataccccaccttgcgaactgttttgataatattctcaggcagctttgaccgcaggtttctgatgtgggaatgcaaagtgcttctgtcaccgttaaaatcatagccccacactcgggacaggataatttcatgagatacggtcctgcctctgttctgtaccaaaagcaaaagaatttcaaattctttgtaagtgaagatcagctcttggttatcgtagaatgctttaaagtcctccggcagaagcgtcagtctgccgcagcgaacttcttttgccaatgtgccgcttcgccggagcaaggcttccacacgtttcagcagaagctgaatcttaaacggttttgtcacataatcatccgcctccccgtcaaacgccttgatttgattctcatcatcagaaagcccagtcatcatcagaataggggtattgttaatcttgcgaaactctcttaaaagcacatgcccgtttattcccggcagcatgatatcgagaatgacaagctgataggtgttgtcataaaacctggcgtacgcttcgtcaccgtccaggcaggcgtccacttgatatcccgcttcatataaaaaagctttgacaatgctgcagatatgctcatcgtcctcgacaagcagaattcgtatcgacataaatgtatcctcccctaacaagataacacagcaatctgtagttcctctgtagtttctaaattatttccattcatattttaaccgaatcaagcaaatagaggagcggattgcgaatatccgcttgacttttttgtcccggactttcggccgcagtccttggacggggatctcaaataaaaaccattatattatctattttcatatccgttaaaactgctcgtcccttcattaatcctgctgatttaagctcactttaatcatactcaaacgatttattaacaatatataaataataaaaaattaagatttccttacggtaaaattatatgaatttatcagtatgattcatatatcaatatattccccaaaaatatatctgaccgatagtattggcagtaaaaatcaatgctgtctggaataagcatttgaaatattgttctggtatatatggtaatggatctttttcaatgtgtcataatttgaatttatttcttattatcagttgcataatggaggtacaatataatgattatttcttttcgctttaaaaacttccgttccttttatgacgagacatttattgatatgaagacggattgctgtaaagactttacaaatcatttagccccttttgaaaacaaatatttactcaaaaccttagctgtctacgggaatgatgcaagcggaaaaacgaatttgcttcttgcattttccggtttccaggctcttatcttcaaacagctttttcccctgaaaacaattccgggcatttatcttgttccgcatttaaggtcaaacagcaggactaagattattccatatcaaataactgagactgatccacagcctacagaaatggaactttcctttcttagcaaccggcatatttatgaatatggattcactatcaaggaccagaatattctcgcagaacatctaattgtggatcatcatatggtatatacaagaactgacagagagattttcatatggtttattattttaatacttttgaatcattccaatctcttagggatatggaaacagaaagaaatatataccaaatttttgagaattctgatgcgctcaattacagtctgaaccaacttcaaaaacttggatttccaatagaagattttatcattgaacatggtgttcccaaacttggatttcgtattaaatcccgggatacaggcaagtttataatataccatacggactatacaagcgtatctatgaatacaataaaatatctatgtttttttataaaagtatatgagttatctcaaacagggggatattaataattgacaatatcaccaatgagtttcaatcaactgttattaaatttatagtagattccttctatcaggaagacaacaagaatattcagcttattttcacaaccaatgatagctttatattaaataataaacagttacagtacgataaggtcgctgtcgttgatatgaatgaatatcaagaatcccggttctacactttgactgatatattggttcagcctgattcaagccttttaaaggaatatcttttgaaaaaatatggaacgatgactctattaaaagatcctatatgaatccctaccaggcctaagagatgcatatcagactatgaaccgcggtttcataaaatagaaaaagcagcagaagcctgtttgtgaggcggttctgctgctttttaatattcataaataactaccgtttccggtaaccctcttacctcggtaagaaagtggtttattgttttttctgtaatttaatttcttagagtgagaggttgttgcaggtattgctcccattatatcaagaacccgcattatacaaacaagcaccatctgatgccatatttatcaataaactccgccatcagaggactaaattcacatgaagcaagcgacgtaaggattttagcatctgttttcaatacttcatatgcccttcttatcattccttcctcttcgacatgtttattcctgaaacaattctattttaccattaagtatatgcagtatccagactttttaaggaattctcctatgaagtcaatcggatattctcaatccgctccgctacttgcccacaggtgtctcgctccacggtgcataacttcttagctgctatcgcagctagttaaaaggggcttgagccggaagacggatccatgctaagtaattggctttattttaatcagataacccataaattttttaaagcaaatattccagatggttgcgtaaacaagcgaaaatatataaaaaatcaaaaaagtcaacgggattgataaagaacctgttaagtccgtgaaggctgaaatatgtattatgtaagttaagcacatcatccctagagataaggctatgcttgaaatgaatatagaaataaatattcctttcctgtaaagcaatgttcctattaccatgcctaatgcccctgttgtaaagaaaagaatgacagcttcttgtatattgaatacaacaagaatcagtgaagatgaaaaaagtacggcaaaaccaagagaaacgtgaaatactgcggctattgcaacaggcagtgtactaaatggactcaaagctaatccaatggcaggtaaaaatacaggtgctgattggaacagcaccgttattgttgttaataagcctccaatacaaataagccagaccatatttatttttttcactttaaatactccatttatatgaaattggtctcaaatcaaggaagaatttcaaaaacagtgccttgattgaaatctgttacattggaagaaccataagcccccaaatataatttggtctgatccaggttcgttcccagactgacataaaaggaggactgagatccaaagtcataattggtttgaatcacactaaaatcgtttggtctgaaatctgtccttattctggtataggccagcgtgcctctggccggaaaacggggctcttcatttcgggcaaagtcagtaaacaagaggcttccccttaagtcagggatttcactccccatatacggctggacccctgtaagtgctgttcctctaaacttgtcaggacgtgggtcttcatgaaaataactggttatcgggtgaatacgaaatactgcagtttttattgcttcatcgtaataagctatggttttctcatctaatgcagggtttgcagaacagttattgatcatcgaagtaggaaaagatccttcccacccccgccagcctaggttaatatatgctttttcctggctggaaccggatcccgttaaagctgattgaacaagctgtgtgaccggcattggtctatagaaaataaaagaaaaaatggattcttccaggtcctgtcccacatttcctacatatttaatgtattgaccattggatcgctgataggaaattcctgtaggattgcgaacccctttggcaattaccgtaagcgtatcctgaacaggcactgggatctcgtcaaagcgtgtgactggggaaggattatcgatggatggattcttacttacatcaatttcaattattttgccggctatttccatatcattctgacttaaattaaacggatcatatcctgagccgccatctccggttgttaaaacgagttttcctgtttcaggtgaaaaattcaaactattaacgccattatgattcataaacggccttctcaaattaagtaatgtccgttgtttttgagattgaccattagcttgtaacccccactcttcaacagtatcgatatggtcaaattccgtttctctgtttatccactgtagatttaaagtttcaggatcacagggatcaggctgaaatgatccaggaagggcacccggtccttgtgtccctgctactgaataatgcagataaaacaagccattataataaaactctggatgaaacgccagtcccagcagcccccgttcatcatatccgccgctggaaacgcccagatttattatttgcggacgaatatctaaaaaagtccttatattttcgtttgttacatataagatttctcctacctgagttgctataaataaactctctgtgagatcgcccggaagtattgctgttttcaaaacagtgggtaaattaatattactggtaatgggacgtaaattgacattaacctttatcaaatttttatctcctttttttattagaatatgattaattctgttctattagtactgtttgccaaaaggggagttcactgacaatgctgcttcataagtttggttctttataagtacaccccggataacctgccggaaaatacaggaaatcacactcctttgtctagatgaatttcatgccagactaacgattttcactgcttacctgttcgtacgctttatcagacaagtggcgggttttatccaatcggccatctggctttctggcctgagtaaaaacttctccggaattttttcctgtcactgcaatctcgttgtgcagtgtttttattgaaccaactgcttttacctgaatgttttatcgcttgttcaaacacaataggagggtgcctcaaagccatacgaaacggcttttaagacaccctcctgaagcataagcggtcgctgtcaaaccacggcatatatttctacaggtaccgcctgacctttgtccggtaacgtagatactcctctccaaaagcacctgccagatatctttcttcaccaataatctgaacgtggaataagacaaccgccaaaacagatgctaagatattgatccagttggggcaggccagaacacagccgatatagatcagatcaaaccctacaaaagccggattgcggctaaaacgatagatgccccatgtcacaaggcttgtgttctgattgctgctgaatccggcacgccagttattcttcatcacagtgattgccggcaaaaagaaagtgcagcctaaagccataataatcaatcccataatggaaagaggcggccctgccggcaaagcaggtaagtgtctggggaaaagcacactggcaaactgcaccacagcaccggtccctgttgctgctcttaaaagcagttcaatcactctcgcctttgccggcttatctcctttgccaaggaggttcccggagataccgtgacgccggagcagcatcattttaatcaaataaacagcgtaaaacaggcagagcagtgataatgcaatccgctgaatcatactcatcacttcctccttatcacccgcgtggcatttaagacagctaacagtgtaacacctacgtcagcaaacacagcctcccacatgcctgcaacaccagctgctccaaggagaagaaaaattcccttgattccaagggcaaaaacaatgttctgccacacaatgcgctttgtaaaccttgcaatatcaatcgcatcggcaagtttggaaggttcatccgtcatgagcacaacatctgcggcttcaatcgctgcatcagaaccgagcccgcccattgcaatacccacatctgcccgggccagtaccggggcatcattgatcccatcgcccacaaaagccagcttgccttttccttgtttgcggctttccagcatttccaccttttccaccttgccctcaggcagcaatccgccgtaaacctcatccaaagcaagttcttttgagattgcctcagcaatttggggatcatcgcctgtgagcataattgttttgcggatgccacgggattttaacgcggcaatggcagccctgctgtcctcttttatttcgtcggaaatcaccacacacccggcgtacacattatcaactgcaacatagacctttgttcctatttcagccgattcttcaaaggaaataccatttgagttcatcagcctgtgattgcccgcaagaataactctttcatccatacaaacacggatgccgtgcccggatatttcattatagtctgtaaggcgctttttatcgatctgcttcccgtattccttcgtaatggaaaggccaatggggtgattggaaaatgcctcagcgtttgcggcaagctctaaaagctgttggcctgtaaacccgtctgcaggaagcagttttgtgaccttgaacacacctttggtcaatgttcctgttttatcaaacacaacgatttccaaattccccaatacttctaaatagttgctgcccttgaccagaacgccgcgtttggatgcgcccccgatgcctccgaagaaaccaagaggaatagagacaaccagagcacaggggcaggatatgacgaggaaaatcagcccgcgatgaacccagtcaccccaggcaccgtaaaagaacagaggcggaataaccgcaatgagtgccgccaaagcgaccaccaccggtgtatagtaacgtgaaaatgtggtcataaaattctcagtgggtgctttgttgctggatgcattctccacgagatcaatgatccttgccactgtagactgtccaaatgtttttgttacctgaatggtcagcacgccattttgattgatacagccggacagcacttcgtcagatacctttgccttgcggggaaccgattcccctgtaagcgcctttgtatccagcatggcttcgccttcgacgacaatgccgtcaaggggaatcttctcgccaggctttacaacgataatgtccccggataaaactgtttcaggcgataccttgatcacatcgccgttccgtctgacattggcgaaatccgggcggatatccatcagatcagtgatggattctttggaacgccgtacagcaaggccttgaacgtattcaccgatctgaaaaaacagcatgactcccaccgcctcagcagcatccccgatcagaaatgcgccgatggtagctatggtcataaggaaattttcgtcgaatatctgtccccgcaaaatattcttaaacgctttcaatacaatttcaccgcctaaaataatgtatcctgttacaaagacagcaagcaatacataactgttgatgcggaaggcatactgcaaaaccatccctgcgacaaagatggcagcaccgattataagcgctgttattccgttcccgtcatggtcgtggtcatgatcgtgatcatggccgtgtccgccgcccgtgctgtgtctcttctctttttctgtcacaacaatgcccggttccaaccgctctgctgtttcacggatcctttgcagcatgtctgcatgttcatctgtaaactccacttttaacgtggcagtcatcaaagtgacggaggcatcggccacgccttccagcctcttcaccgcagtttcaattttggctgcacagtttgcacagtccaatccctttagtgtgtattcttttttcataaatcatccctccattcatttaatagttgagcaatcattcaactttttgagtaaaaaaagagcttgttattcatggatatgttcaaaccctttttcaaatatgtcttttacgtggtcatcggcaagtgaataatatacttccctgcctcttttttcaaaacacaccagatttgtcaaccggagggatttaagatgatgagaaattgcggacttcgtcatattcaaaagcacggcaagatcacaaacgcacatctcatggcaggataaagcccataaaattttaatacgggtgttatctgagaacattttatacagatcagataaatcccgaaaatctttgccatcgggcatggcacttttcaccatgtgaattacatcttcatgtatggcatcacaatcgcaggtgaaattcgtatcctttttcattctatacctcctaatagttgagcattcattcaactattatcattatatgccggctgattcaatttgtcaaccgctgatttcaggatatatgacaaatataaaaacgtcttattccggtaagtacaacggcatttttatagactaatatctcccttccaacggccgggccttccttttcttgataaacaccatctatggaatcaaatttcgttttgcctctcccccgccaatatcatggagaattgcagctattgagatcaattccctttccttactgcttacgtgttctccatccatgatatcttcggcatttttaagtaccttaaaggtatgatctactccgaaaggaatttcttcaaatatttctttggcactgtgtcaggtgttttttatggaattatatctaaaaaagactatttcttaataacaggcaaaatgtaatccagtgttattctttcgcctttttcctgcggttcacaatatcgtttataagtatagatatcacaccaataaaaatgccggaagtcaatttcatatccggtcttttcaatggcttccttacaaagcatgtaggcacacgcaataatattatccagggtatccgactcgatccatattcttgcaacggtgccggccggaatgttctcactgtagaggccatccggtacggatgcagctgtttttacaaattttccaatgatatattgaaaattattttgtccttcaaatttgctcatatgcccaagaccaatatacggatcctggtccggacatacccattcatcgatttccttcagtttgtcaaatgttccattttgaaaagcagctccccagcattcctggccggctttttcaaaggtggttctcttcatcattcctacaaccatacgttcatcatattctgcatactcgattctcgtcatttcagccataatctgtttttctcctgtcaggcggatattagtaaaggataggcggatatatctattgcatttcaattaactccacaaggtttttaatgtccttttctatcaatggacgcatagtatctttaaattgtgaacaatccatggaaagtacggcttctttgatccggctgttcagctcttttttatatggaacaatatagtgcagatactgtaacgcctgtctcactgccgttggtttttcatcatatacagaggctaatatatcttcaatcacttcgttgattttattgtgttcatcccattttgcctgtttacacagcagccggaatcccctcacccggacaacatacctgtcactctttaacatggataaaaattcatccaaataagggacgagaatattttcctgctcagaaagctcctctaattcccgtaagattacatatgaatcctttgtatctttctcataaaggtatttaattctatcatctattaccattctctcatacctccgattaaaataaaccattctacctgacgattgaatacattttcatgtccagaaccacaccgttttttactgcattttttctcaaagtaccctcatattcaaatcccgctttttccagtatgcggcaagacgccgtattataggaaaagggctgggcaaaaatacgaataatatctgtattttcaagaatatatttgcagacctgttttacagcacttgttccaattccttttccccagtacttttccgaaatataatatcccatctccgcagtttttgaatgaatattgtctttacgaaatacgccaatgctgccaaccgccatatcttccactgtaatggcaaatgcataagttgttttcttatcggcattaagcatagctgtaataaactcttttgcatcttctgtccgatagggataaggcaatccatctcttaaattatcaagaatttttttgttatttaatgcttgcgcaaggtcggatgcatcctccggcctccagcagcggatgttacattccatgtactgttctcccttcccagttaagcgaatattcccaatccgctttgttacacaattcggttaactaattgaatgaaaaatgtatacttaattcctttttacactgcatttattctaccatacaaaccaaagtctataaagacatacgcaaaaattcgctatcatatgatcttttttcctcagcttatccctgcctgccggcccaatacgccggataccatttttgaaaccacagagtaaacacacccataagcgcaggacagactgaattaatgaggcctgtatagggagataagctcgttcccataagtaaatatgtccaaatcgttgttatgagatataaaacccccaggcagcggtcaatatccggttcgtccgcataaacagcggattgtcaaatgctttttcattgccgtagctgtttgcactgtaataggaggtcaggggttttttagtaaacgcacccacaagccacatgaacccaaaagcgccgtagcttatgggcaggatgacccgcgggtcggcccccagcaaaagggaaagtgacagtgcaacaacaacaggcacggtgatctgctcaaacaaaacaggctgaaaaatgagccagagcaaaggcagagccgctgcggccaggacacctgctataccgcctgccaccccattgatcgcaacggttatccaaatgacgagccacggcgccaggagaacagacatatttgttttgcggcattgggtttcaaccgccgctttaggacgcgccgaagagccaaacaacttatcccatttaagcatcagttcaaaatcacccaaaaccctgtactgccgtttaaacatggcctcctgcccgctgatctcccctctggcaatggaacgccagacagaaaacggtgtctcaattttcgttgtaaagggcctgaagttttcagaaataacttctgagccacttggggtaagtaatatctgataggttttatcaatatcggtgtaataaaactccaaaacccgttctatgccgtcaggtatgtacaaagcagccatctgtttggtaaaacttaagctttcttccagaggctgttggaaatccgcactgacgccccaggaggcgtccgccatcttttcaaacacagctcgtggatataagggcccggaaagctctgccattgtctcctctccgattcctccgcccacatattctgcccccgctttccggacaccttccaaataagcgtctgtcctgcctcttaattccggaacacgaaacaattctccctgaccacaaaaaatggccgtgtacttttccggaccgcagaaatggtcaaacattgcagcaacgccgtcataattgcccttggccgtccagaatccgcatgtggatattacaatatgatgctgctgcgtcaaatcatagcgggagggatgtcccacgctttcactcccttttaccataaacggctggttgaggggcagctgccggtcaatgagatttttaaggctgccgggaacgctgaaataatacaatggaaaagaccatatgatcacatcagccccaacaattttaggaagaatttcgatcatcttatcgtttataacacattttccaggcgttttatcccaacaggaaaagcagcccaggcagggttttacatgggctttccatacatccagaatttccgctttctcccagcctgcaccttctaaaaatgcccgggtaagctttaacgtattgctgttttcgccttttggcgaaccattaataacgagtatgttcatttttcttccccctccaaaatggcaatcgctttttccacccactcaagccctgcttgaaaagataattctccatacagggcaacgatactccaatacttcgtcctctccttattatctacaacctccccataccgggcaattgactcgggtaccgtgctaaactccaaaccatactttaagcatgattcccggtacgcacgaagcatggtcaatgcctgtgcgtctcccatttctccggcaaaaaacatacgcatgagaaatgcattttttatgcgcattgtggcggcaatatctgattggggtgataaaagccaattattaagttcttttttccccgtatctgttatggaatagactcttttatttggtttatctttttgaatgacatactcactgctcagccagccattttgctccattgcgtcaagctccctatatatctggctggtttgtgcctgccaaaaaaatgacagggattccttaaatgctttatccagttcatacccggtcataggaccatagtttaaaagcccaagcataccatgtttcagcgacatgaatagcctccttgttctatattctatttgttgagtatataataaaaggaatatcactgtcaacccccaattaccgcagaagataaatgaatataagttaggcaaagcattttaaatttatcgtgcctcaaaaaaaagcaaccgtcgcgcataacggttgcttttcccctataatcaaatcattgcctggcatttcgtgcacaaaacaccacaagatgttacgttttgcatatcttctattgcccatcctgcgagctgtacaaggatcggcagaacactctttcctttttccgttaatgtatactccactctcggcggcacttcgttatattgctctctgtgaatgattccggctgcttccagttcttttaaggactgtgccagcatcacatttgtaatatcacctaattttcttttgatcgtgctataccttaaaggcgtttcgcttgaaagaatgcatacgatgggcagcttccatttgccgttaaatatattcatcagatggcggataggacagagcaattcttcggttgactgcatggtttcctgctgttttttggcgcacatattatatccctcaattccaatagtatgttttttattacttagtaagtttttactgcgttattgaaaaaaacttatttaataatataattatattacagggtaaattttaacacaagttttttgagcggtaatctccataagccggcaatttaataatatcgaaaaggagcatgtgtaccatgttaaacttaaatcatttcatgaacaatggaataaaaaatatttctgatactgccgggcggttttatttcggcaatcgccgggggcaggcattcatgctgcacatggcatctgatctgcataaaagtgcaaagataagatcacagcatgaacagaacggcacgcatatccctccttttctgattgccagcatagcagctgattgtaatctgcggtgctcaggttgttacgcatgggctaacggcagctgcggtgacggacgggagccggaacagttgaccggcggcgattggcggcgaatatttcaggaagcgtcagacattggaatatcttttattttaatagccggtggcgaacctcttttacgtcatgatgtgatccaattggccgcggaatttgaacatatcatttttcctatatttaccaacggaaccatgattgacgcagattatctcagcctttttgataagcatcgcaatctcatcccggtgcttagccttgagggcgacgctgaaaaaacggatgcccgtcggggaagggtgtctcaaataaaattgagcaagccgctgaacgcctcaaagaacggggaatccttttcggggcttccataacggtaacaacggaaaatcataatgatgtaacagaatcggactttgccgagactttgcgggaaaaagggtacgggcttgttttttatgttgaatacgtcccagtggaaaaaaatacagaccatttgattttaaatgaaaatgacttgcacatccttgcagcacggattgacggcctgcgggaaaataagaaaaacaagggcatgatattcctctctttcccaggtgatgaggaagcaatgggcgggtgcttagccgcaggacggggcttctttcacatcaatgccgcaggaggaaccgaaccttgccccttttccccttattcggtaatgaatctgaaagaacagtcgcttttgaccgtattacaatcaccgttttttgaaaaggtgcgcgaaataggcgcggcggaagccttgaaccataaaggaggctgtagattatttcaatacgaagatgaggttgaacaggtgatcctatagactttgtttatttaggaaaggaggaaaccgtttgggaaatcagcctgggcaaaagcataagccggattttaggtgacacatttacgattaagttccttgagaaaggtgaaaactttggagtaagagagtttcaggcaattgaaaaggaatttcccgaagcatatggtattgttcaggaagaagatgaacatggaaaccgtctgatggctatggtgtctcctttatgattggattgcatgcaaagtcattgcttggcactgatgtatagggaaatcgataaactgaaaaatattataattaaggaggtttatacatgaatactgctgtacgttactttacccgtggaggcaatacaaaaaaagtggctgacgcaattgccaatgcggcaggcgttgaagcaaaaaactgctctgcgccccttactgaaccggttgatttactgtttttaggcggttccgtatattggggaggcatagacaaaaatctgaaacaatttatcgagcagcttgacccggccatggtgaaaagcgttgctgtgtttggcacatcagccctgaaaaaggagccggaccgagaaatagaaaagcttataggaaataagggcatccccgtgtccagccgcagctttcattgccgcggagagttttccgctgttcacaagggccatcctgatggtgatgatttaaaaaaggcggcagcctttgcacgaactgcattagaagcaataaaataattccgaacagcaggtttgaaagaaggtatccgccatgttgaagctaagccattcagaaaaagattatatggaagcaatctacattctgaccagacgttttgatccggtccgttcaggcatcggcatgctgctcacccgaagccgggccggaaaagcggctggccatgccggttccgatcttcatgctcttgcacatgcatacggcttctcgttccggtgggtgatcggcttctccgcagcagcggtcagccctacgctgttcctggctgttcataaaaagacgaaaccggaagctgagaccgcataatgcttcatatcttccaaatttggctttgtgcggttgtttttctattttaactgtagtaaaatcatatacaatacacgtttaagccatttgtttttattcagaaacaaaattgttgagggacaataaaaatgaagttatgtattggcacagctccgtgcaaggtctgaagcggacgaaactgcacggagcggatcaaattcgtccgttgggctttgcactttcattgaattttatgaaatttatgaaagaggagcaaagtcatgataaaaaatttaaaaacaaatatgggagaacttcggtccttcctgattttatggatcacgcagtccctttcgtcgctgggcagcgctatgacgaattttgcagtggtaatctggtcttatcagcagcagggttcggcccttgccacagcgcttttaatggtctgctcttatgcgccttacgtattgctgagcatgtttgccggagctttaagtgaccggtggaacaaaaaggtgaccatgcttgccagcgacagctttgcagcactttgtaccgttttggtactgcttctgctggttacaggcaagcttcaggtctggcacttatacctgctgaacacattcaacggattgatgaacaccgtccagcagccggcttcggatgtttccataactctgcttacacctaaaaagtattatcagaaggtaagcggaatgcgctccttttcccaatccctggtcactgtgctgacgcctgtactcgctaccgcgatcctttcctttacaagtatccatttcgttattttttttgatctggctacatttttcgttgcattcatcgggcttctgtgctttgttaaaattccgaaaataagggaacagacaactgcaaggcaggaaaccatattacagtccgtaaaaagcggtctgcaatatctaacggataacaggggaattctggatttgattctgtttctggcggtgatcaactttactgcgtccatattcagcgccgctttaccggcgatgctgctttcacggacaggagggggggaatttgctcttggcatggtcaacacggctacaggaattgccaccatgtttggaagtcttatggtcactatcctgccgccgcccaaaagcagagtcaatgtcatctgcaactgcctgctattttccatgagtacggagaactttattcttgcatttggccggaacacgcccatatggtgtttgggatcagtccttgggtggatcttcattcctgttatgaatgccaacatggatgtgcttttccgctcaaaaataccggtcaacatgcagggacgtgtttattctgcaaggaatacactgcagtttttcacaattcccttagggtatttgtggggaggaattcttgttgacagggtgtttgagccatttatggctgctcaacaatctttaagcagtccgtggatctcactgtttggaaccgggaaaggttcaggcgctgccatgctgtttttcgtaatcggcgtttttggcgctttatcctgtctgccgtttcgggctgacaaacacatctggaaattggaggaatagcggattccttcatcagggaattatgatacgtgatatcaaacagcacagagcagttctcactgctttctgtgctgtttttgcatgctcaggatattaagaacatgccttctgtaagaacagtggatttgaatggatttctatggtaagctggaaatagatcagcaaaaatagtcgagagggttttcttcgatgaatgtaagatagtatctgcaaggaggtgaaggaatgaaggaacaaattgaagcggttcagcgaatgcaggattatatagaggttcgcatttcagacagcattactcttgccgacttatcagaggtatcgtttttctctccctggtattcctaccggctgtttgtgcagcacaccaacatgacgccggccgactacatcagacggctcaggctctctaaatctgccattaagcttcgggatgaggactgcaaagtcattgatgttgccttagaccttggttttggcagcgtggacggctatcagcgggcatttttccgcgagtttggatataaccctaaggaatacgctaaaagccctgttcctctttatcttttcacgccttatggagtcaaatatcgaacggtcagaaaggagaaagccatgaaaacagtaaaaaatgtgtttgtacaagtaattgaaaaaccggatcgaaaggttctgatcaaaagaggggtaaaggcctcagactattttgcttattgcgaagaagtcggctgcgatgtttggggactgctgcaaagtatcaggtccatcagcggtgagcctgtgtgtatgtggctgacagcaaatcacatcagccccggcacctctcagtatgtgcagggcgtcgaagtgcccaccacctatgacggagttattccccagggatttgatgtaatccaactgcctgcggcaaaatacctgatgtttaagggggagccttttgctgaagaggattattgtgaggctattgaggaagtacagtatgccataaagaaatatgatcctgctgtcataaatgcaaaatgggataaaacaaatccccgtatccaactggaacccataggaccaagaggttatattgagcttttgccgattcagtaattccgtacagggcagccataacaggctgcccttccagtttcccagtcagcataatcttctgaaacaaatacaaggatttctttttttcatgttcctaccctccccttttctaaattctctaaaatttcattatatcgttttgtggctaacccactgggtttcccctttttacagaacaaaagctttcctaatttgggtaccacccgttccacaaggatctgaccgtcaacggtttttgacttcaaggcttccagtgcttccaaaaagcggctgtccttccttgcccggccataaaaggataaaacatagacatattgaaacaggttataattgcggaatggatattctacctgcatgaacagggtccccattccataatggcagggaccgatgggcttcctgatcagccagtgttcaagcaaaaaatccaccgccttatcaagtgccggttccttattcagatatccgctgaaacgaaatgcgttgagaatattcagggtaggcatgggattggaatactctgtttccggcccatggccaaaggaaaatttattgcagcgccagccgccgtcagaatactgggtatctaaaaaatgctgaaatgtcttttccattctgttgtcaaaggcatatcccatgtggcagagcacgttggccgcaatcgccgtttgacacggataaatgccgcctttgggatatattttaaaacgcccgtccttcagccacgtgctgaaaatcaaatcagcacaatcctttaaaaccggttcgtcaggggacattcccagctccagcagataaagaacactgtcaaatgttgaaaacggggagccttttaacaatcgtttgtcagcagttgcccaaagatcagccccattgtcatgcctgtgtgataaaaccacttcaacatcagctaaatattgcttttccaccgccatcttatatccctccataaaattaatgcacatcctgtatccccaattataaagccaaaataagacaacagtgtgtcatgtttcgtactgtttttgtgcttctctcaaaaatattttcatctcatcacgcaaagtatccggcgaaatgatttccgccctgctcccaaagccagcaaatgtgctgacgacccaatcagggcgttccgtttgaaaagaaacaaatatatcgttgttttccttccggatgttctctgttccaaaaaaatcaacggcaagaaactccagagatttgtccattctgacggtgacagccattcccccgtcatttgaaaaatcgcttttcaggggcggaatggtataatcctcccgttcgtcaaaggtttcttcgcttagatgtaagcttgtcatcctgtttaccttgaatatgcggaaatcttccttgtatttacaatatccgaaaagataccagttttcctgtttaaaaatcagtttataaggttcaatgaccctggggtgataaccacttcctccgtagtattccatttcaaggaggcgatgacctgcaatggctgtccggatcgtcctgattttctccgtgatggtgctgttatggttccatgatgtaaagtcaatgatgatgtcatgttccaacagcattttatcctcatggctgaaacgcagttttgcaagcagagtttttatctttgcactgtcatcaatacttgccaatccctgtatccctgcaagaattgcactcatgtcctccttattaagcgcggttttgctgtatttaaaatccggcagcaaggacactccaccaccaatcccctgccgggaaaccacaggaaatcccgcacttgatatgtctaataaatcacgatggatggtacggacagatacttcaaagtaatccgctaattcctttgccgtaaccttttctttttctaaaagaatacacaatatcccaaacatacgattgcttttcatgcttttcacctccagtatattataaataaacaagacatttcatgtcaagtttacataccttttcatcaaaatctttaaaccatagtcccagatctgaagttcagatcaaaaaaagaagatttgcgggagcaaatcttctaaaacaacatatataatttattctttaattaaaacccgggccatctgaatgagaaataccagggtgcgcagtaaaaatacacccccggctatcaaatgaatccagggaaagtttattgcccccaacacccataaaagtaacatcacaatggcagcatcccccatataccgcccaaacaaaaaacctattttttcttcctttggcgacagggatggctcaggacttataagccagcgccgcctgggagaagaaaaaacaaaagaaagaaaagccaaaagcacaattccgaaaatcatgagatcaatccgttttctttcagaaaatctctggctacatcagcgggggactgctgcagttcatctactttataattaagttcaatcataacatcattggttaaaaccggtgccagttcttccataataccggtaatttccggatatttttccagagcatccgcccgaataacgggaattgcgtaataaggcgggaaaaattccttatcatcctccagtgtttttaagttgaactttttaagaagtccgtcggtggaaaaggcatcaatcacattgatctcaccgttttttaaagccgtgtagcgggggcagcatctaatgtaaggctttttcccatttgaaagccatatgttttcagaagcccggaaagcccatcctcccggttggagaattcaaatgtagtacctgagatcagggtcccggctattccggcaagatcactgatcttatctaagttatattcttctgccatttcctgggtcacagccagtgtaaaagtattattaaagctcatctgtttaagcacttccagatcaaactgctctttatactcttttaccacagtctcgtacacctgctccatgtcactgataggcggatgcttgaggatatcactgtaggaggttccgctgtaatcaatatagaaatcaatgtctcctgtctttatcgcagagaaacatacctgtgaaccgcccaggctcagttttctgtttacggtgatatcggttctgtcttctattaaatcggctaacatattcccaaggatctcctgttccgtaaaatccttggaacctactgagacagtacgtgcattgcctgatacattgcccacggatgtaaaaaggaatacaaccgcaatgactcctgaggctgctgcaagcattgccttttgcgccttccgtctttttttcttaactgagttatctcccttttgaaggctgaccggggttaccagcttctcaaccagtccgatcagaaagtctaccataagtgccagtaaacaggcaggaatggcgcccgccaggatctggttgttgttcaccgtacgtattccggagaagaccagatatcccaaaccgcctgcaccgataaacgcagccatggtcatcagcccgactgccgttacagaagcgatccgcactccggccatgatgacaggaagggcaaggggaatctgcacctttgtcagcacctgaaacggcgtaaggccgattcctttggcagcctccagggtttgaggattgatattttcaattcctgtataggtattcttaatgatgggaagcagagaataaagaaccactgcaacaatggcaggaatcacaccgatacccaatattgggatcatgaaaccaaggagcgccatgctgggaattgcctggatcacatttgcaaccgacaaaaccggcttgcttgctttggccgcgtaagaaataaaaataccaaggggtactccgatcaggatagccagacccaccgatacggcggtcagcttcagatgttcaatcaataatgataagatctgcggataattgcttattatataattccaaaagttcattctgtctctcctccttcatagtcaaaatattgctgacttaaagtggttaccagactgcttcgtgttataaggcccataagacgcctctggtcatccacgaccggaaccgtggacacatggttttcagtcactactttcagagcatccagaatgcactgctccggtaaaagagtaggaaagtcctcatacatatactgctctgccaactgggtcctgtcttcaattcctctcagcctgcctgcctttacaattcccaccagccgcttgctgtcccgttccaccatgagcaggctgtcaaccttattctggcgcatcttgtcaatacacttcaggaccgataaatccttggtggcggtgaccggatgatcgatcatgatatcggataccttgatatattccggtgataaccatatcctgttttttcctacgaagttggaaacaaaatcatccaccggattgtttaagatatgttccggtgtatcatattgcagaatatcgccatccttcataatacagatcatatctgcaatcttaatggcttcatccatatcgtgagtcacaaaaacgatggtctttttcagcttcgcctggagctgcaccagctcatcctggagatccgatcttgtcatgggatccagagccgaaaatggctcatccatcaggataatatccggatcagtggcaaaggctcttgccacccccacacgctgctgctgcccaccgctaagctccgttgggtagcggtgcaaaaactcctcgcagtccagtcctaccatctgcatcagtttccttgtgttgtcctcaatgtcttttgaagacattttttcaagcttcggaatcagttcaatattttctttaaccgtcatgtgaggaaacagccccgtctgctggatcacatatccgattttcctccgtaaagccacttcatccatgcttccgatacttttatcgtcaatataaatcgtacctgatgtgggcttaatcagccggttgatcatttttaagagcgtggtctttccacagccgctctcaccaatgatagctactaagcttccgctttttatcgaaaatgtaacttgattcaaaaccttatttgtcttataggattttgaaatctgttcaaattgtatcataatttatccctcctttttagcaaagtaacaacttaattatattgcaaagttgttactttgtcaaatttcaaaaaaaataacgcctgaagccaatgggcttaaagcgttataaaagagcggttatttagaagaatataagaattcttttactctgtcagcggtgtcatcctgggtcacaaaatatatggtatcattttcagaaagggcaacatacggtccgggagattttataacagtatcgttcctgctgaccgcaattacagtcgctccggtacgctgccagaactgaatttccgttaccgtcttatttaaataattgcattccctggtaatccgtatttcaaacggcataaagggattcattgaccggaaatgaaccgaggcctcaatcagatctttcaggcagtcatttaaatattccatttccagtttttgacggctgacactttttaaaaggttctccttaatggtatcaatagtctggcgtttgccgttttgccggatgtactccgctgcttttttctgggacttaatgataatcccgttgcctttctcagtggatacgatccccagatcactaagtatgcagatcgcccgccgtgcggtctccggtgatacgctgtactggctggcaagagatgaacgggcgtaaattttttcgccttcctgatattccccgttggcaatccgggccgccacttctaccgcaatttgctgataacggggaattgctgttttatgttttgtatctatgttcatgtaattctcatttcctttgcctgttataatataaaacaacatcagtatagcctaaaacccattacagtgcaaggtgggaaccgtaaaatatcgtaccagtcggttttcttttatttcagcctgccataatcttcatcagataccacttccagccattcattggatcccccatctgccggaaccttaaccgcaagataagaagaccaactgtcaggagctgcgccgtgccaatgcttcatctcctgaggaatgttcaccacatcatcggactgcagctcctgtgcgggctttccccactcctgattgcaatagtaaattcatgtttacataggcaaaaaattaatccatttcatatttatttgtgttaaaatatacagtgcaaagataaaaacacagttccggtcggtagtccggacgcagcgcaagctgtcagtaacctgcctccttggttgtccgttctttgcaaggcacataaaaggaggattttattatgagaaagactggttccaggctgaccgtattatttgaagagcccttttgggtagggatctgtgagcgtgaatttgagggcagatatgaagtcagcaaaatcacctttggggcggaacccaaggactatgaaatctatgatttcatactcaaaaattatcacaagcttcggtttagtccatctctggaagcatctgcaatgactgaaaggcgcttgaatcccaagagaatgcagagggaaatcgacaaactgctgcaaaataccgggatcggaacaaaagcgcagcaggctttgaagcttcagcaagagcaggtaaaatcggaacgaaaatcccgttcccgtaaacagcgggaagctgagaagcagcgccagtttgaactgcgtcaggaaaaacgcaaggaaaagcacagagggcattgatctctctgtactttttctttctcctgcgatccacacaaaaaaggcagaccactgccgggaaatcaggtctgcaataaataaggatacatactttttacgatttatgcaaaaactttttatgctatcaaaaattacatgaaaacctgaggttgaaaccatgaagctgcacagaaaaaagatcattgcacctcttgtgataaccatactccttgttatctattacatggggtttttggccgcatgcatctatgtgcttttggaacgaatcagggaaataaggagcggtgaagaagatgatcttagtaactactgattatattactggaaaagaactggaaatgctgggaatggtaaagggcagcaccattcagtcgaaaaatatcggcagggatattacccaggggctaaagtccctggtaggcggcgagctgaaatcctatgctgaaatgatgaaccaggccagagcgcttgcgacaaaacgcatggcagaagaagccgaggcattgcatgctgacggaattgtggctgtccggtatgcctcttcctccgtgatgcagggcgccgcggaagtaatcgcctatggaaccgccgtaaggtttcggtgaaaaagaacttactttaataattggtattgcaaaccatgatccgtactgtaccatatcagcatcccatgccctctttttggaatgcgcacatttaaattccattccggatattgcttgatgatctggatgcggtcgcctgaagccaaggccaaaaaggaaatgtaatgctctttatccatgaggtgttcactggagatataccagtcatcttctaccacctggacggacagcttttctccctcttctgctttttttaacgtctgtgcctccagtttcttgccgcagcatgagacctcagcctctcccgtgcaaagagtgatattctggcatgtgggacaaacgaaatacttcgtatttttcatattacctcctacaaaatcgttaggtgtcatatcgccggacaataaactcatgatatcaattcccagaagtccggaaagttccggaataagagaaatatcaggcatgcccaggccccgttcccatttggaaacagttttgtcactaagattcattttatccgcaagctgcttttgcgtcatatgatgttccaggcgcagggcgcggattatgcttcctactttgctgttttgcatgttttacctccatatccggaatctgaagataagacttccgatccttctgttttcatttatttttattttttctcctgctgcttttccagccataattccagcagcgtatttacatcgtcaaaaaattcacgttccgtctgagtttcttttttttgtatttcttcaattatttcaaaggaaaacttggaggccccgaattccttccatgtatctgccatgcagatttcagggcataagtccgttgacagggagaacaggaacctgttttttgcgccctgcatatccgtagttgaccgaaaccagacatcgtcactgccgctgcatttaatgcaatatactcctccaactacttttctgttttgatactgctctttcagagcttttcttgaaggcttatccattttttcaccatctttctaaaattcaggatttcatcgattgttacaggctggatccgctgccgcttgctccactttcccggcttctcctccatatagcattgtaattgtttgttgtaggcttttcaatctacgctccgtagagttttctcctgagatcatatccgtggcagggaaaacgttgtttaagcggaaccgccttctccctgaactaatattttctcattacataatttgtcaaaataacgcccttacgctgtacctgctgttcaataaagacacggtatcccctggcttcaaaaaacggccttgccgttatggaagcatgtgttgtgaacggacccttgggtaatcctgcttccagcctgtcacagagggccgttgcgattccctgtccctgacagtccttatgaacataaaggcggtcaagataaccggtatcatccatgtcaccgaacccgacgatccggccatttttcacagcaacaagggtattatgttccaaaaatgaacggttccaggccgacttatccaaatcttttgctgcccacgcgttcagctgctcctttgtgtaatccccggcacatgtttcatggaccgtaccgtaaaacagttctgctatttctttaatatccccaggatcgtattcccttattatcatgctttccaccatttatccaattctttttacaagcttatgggtattttaccataattgatttccctctgccacaggttcagcagatccgggccatcttccgcggtaaaaagactatttaaacgccccgggcaggagaagagaatcaactgcgaaaaatatacggttaggaagatctatttcaatgcccaatccacatcagtatgccgggtttggagactctatccctgcctgcggtttatcatatggcagaaagcccatcccagtaatacaaatggggttattgtattaaaaaaagaattcccttgaaaaaatacggctaaatggtgtatgatcttattaagattttggcaaaggagttggttcagtccggcgcacttgatattacataatcagtaatataagtgaaacgtggaaacctgaataatcattaacatcataaagacaaaaaagcctgtcgtttccctcaggtcttgtttttatggctaaaaatgactattccaggttttccacacagtaactgtttttaagctgtggaaaacaaattccacagctttttgctgtggaaaatcagaaaagaaaggaaagaaacagcaatgcttcaagcaataagaacatacctaaaaaaacctgatctttttgaaaagagtcaaacgaaattttgggatgacccgcacatctcacaaagtatgctaaaagcgcatttggatcccagcttggaatctgcgacacgtaaattggattttgtaaaacaatcagtcgattggatttcagacatattacccccatggcaatataaaaggcttttagatttaggctgtgggccaggtatctatgctgaattatttaatgcaagaggctatcaggtaacaggggtggatatttcaagaaattcaattcaatatgcaaagaatgctgcaaaagacaacaggtcaaatattcgataccaaaacattgattatatccagtctcctattatgggcgaatatgatctggcaacaatgatttattgcgattttggggttctgtcaggcaaagaacgtgagatgctattgcgtaaagtctatcatgcattgtcaccaaagggctgttttttatttgatgtctttactccttttgagtatgaaaaccgcaaagagtataagatctggaactatgaagaaagtggattttggcgtaaaactccatatcttctgctgcaatcactttaccgctatgatgatgacaatacattccttaatcaatatattgttgcagctgatggtgaaatcgcctgttataacaattgggagcatactttcgagattaaggaattagaaacagctttactggaagcgggcttcaatgatttacagttttttagaaatgtaaccggtgcgaaatatgaatatggcaataacaccatatgtgcgatagcaaaaaagagtaatatacattaactgtgattggtattgacggccggggaagtgccaacctggaagcaatgattgccattgctgtcattttagcggttccagccgtattagaggaaaaattattccggcaaataataaccggcagatgccataaaacgccatacctttttttacaatttccgcgtccgcaaggatgcagtgattttagaatcaacggcccaaatcattaattgcaactgtcattaaggtgaaaactcccctggaaattccagaaaagtccaggattaccgtaaatccgacagaaaagtcatcaaactgcaggatatgctgattatgattatgccgtcattcttaaacctgctggttaaggtgaccgatcaccgcattctgaagaaaacaaagaggaattacccgccccttcttattctcagcattatggtcctgaccaatatttccaaatacttaagcatcctaataaatgcatagataaaaaagtccgtgttttccctctgctgaaagaaaacacgaacttttaagcaaatcaccaaaggtatcccaaaagacaatcattgacttttgggatactctcatttctatgtctgtaattagctgaaatactgcatgaattgctgtacgattcctcgtgtcatgacatcagccatttccagagcttctctttcaagatccccaaatacttcgatggcatccccgaaattctgtgaaagtatataatttgcttgcgtctttatcatatccatgtggtcatcaagcatatcctgccagtcgtcggcagaccaattaggattgatatttgcaaggaatgctgcgatctgagccgcattttcgtaccagcgtctttccgcatcagaggcagcatccacattgccctgcttcagcgccgtaacaaactcatttgcgatagtaatgtgggttctcatcatctccccgaatcctgcagcattatcctgcccatagaacgtaaccaatacatcctcgaaatccatgggattttgcagaagacgatttgttacaaactgcacatccggaagatcaaaagccacactctcaataaccattctcgtccagtatacatgctgtaaccataagagccgcagatagttatttaaattttgctccgcctcagtgatacatgtggaaacaggtggttgcggctgcggctggggttggggctggggctgcggttggggctgcggctggggctgcggttggggctggggctgcggttggggctgcggctggggctgcggttggggctgcggctgcggttggggctgcggctgcggttggggctgcggctgaggctgcggttggggctgcggctggggctgcggctgcggttggggctggggctgcggctggggactcgggcataccagcggcggcctctgtccatatggaatacaaattacctgaccaacaaacagattggttggattaatacctggatttacagccatgattgcctcaacggtagtctgaaaacgctgtgcaataagccatagcgtatcaccagactcaatgatataggaatgcaatcctccagggcagggattctcattacggccacctctccgttctccctcactgcggggacggttacgtggcctttcagacacattccgtcttgtaccgcgagggatacagattatctggcctacaaacagattatccggagttactcccggattcgcctccataattgcctctactgtagtaaaatgacgctgcgaaataagccaaagtgtgtcttcggcttgaattgtgtagggatataatccttccgggcagcggctcgttctgtttctgcgcctccaattctcctcaataacagcttgggtctgggtctggggctgggtttgtggttgggtttggggctgcgtcagaggttgtgtttgtgaaggcatattgagattctcactcgcctgaggtatacagattatttggccagcaaacagaagattcatgtttattcctggattcgcctctataatgtcactaacatcaatggaaagacgttgtgaaataagcggtaaggtatctccgaattgaattgtataggactgcatccctcccggacaattattattcataccattgttgagattttgatccccctgagccggaatctgggtttgaggctgacccatgggctgagtctgcggttgcgtcagaggctgcgtggttggctgcgtctgcggctgcgtcgttggctgcggctgcggctgcgtcgttggctgcgtctgcggctgtgtcataggctgcgtcatgggctgcggctgcgtcgttggctgcgtctgcggctgtgtcataggctgcgtcatgggctgcggctgcgtcgttggctgtgtcataggctgtgtctgcggctgcgtcatgggctgcggctgcgtcgttggctgcggctgtgtcataggctgcggctgcggctgtgtcatgggctgtgtctgcgtcgttggctgcggctgcggctgtgtcataggctgcgtcgttggctgcgtctgcggctgtgtcatgggctgtgtctgcggctgcgtcatgggctgcggctgcgtcgttggctgcggctgtgtcataggctgcgtctgtggctgttcttgtgaaggcatactgcggtttctgcttgcttgaggtatacagatcacttgaccaacaaacagacgattcatatttatacctggattcgcctccatgatttcatcaacagtagtggaattgcgctgagaaataagccataggctatctccggcttgaattgtatagggctgcattcctcccggacaatgattcaaaccgttatcgagatcttgatctccctgagctggaatctgagtctgaggttgcgtcatgggttgcgtttgaggctgcgtctgcggctgcgtcatgggctgaggctgtgtagttggccgtgtctgaggctgagccattggctgagtttggggctgagccgttggctgagtttggggttgagtctgaggctgagccgttggctgcgcctgaggctgggtcattggctggggccggggctgggcctgcggttgagtaggcatgctgcggttcctgcttccacggggaacgcagatcacctgcccaactaacagattattgggatttattcccggatttgcagccataatttcctccacggtagtgcggtaacgttgtgaaataaaccacaatgtatcaccggcttgaatcgtgtaggagtataatccttcaggacaaggagtcataagattactgcctttcaattaagcaatttttcatattttatgattttaaaatcagaatagtacttgtcagcccctaaaaattatattttatataaaataatgaagaattttttcccaaagtgttccattgaccagattattagctaggtttatttcgacacattctgttagaaaatttgaaaaagattcagaataataagggtttttgtaactatatggaaaatatttacaaataaacataaaacatgaattgcttaatgaaaaaacttttgatattattttattacaaatatctacgctttgagaccttacatattaaaatcacttaaagggggtcctgttatgacaaaagagggaatagaaaaacttttcatgcagatgccattaggttatgcctattacgaaattgtctttgggaatacggaacactcacaggaatatgttcttgcagaagcaaatgacgccttctttgatctctggggccttgataaggaaaatgcactgaacaagaacgtatccctgcttctgaaaggtaaaacagaagcccccgcatggcgtacgttttatgaaagtctgggcagtacagaaaaagacaggcatttcaccgtaaccattgggaaacgcagctttaaggtcacagtttataatcactctccaaacggcctggtaacaatatttgatgataccacggaaatccacagagaattggaatcccaaaaggagaaaaacgaaaagctgagccaggatattgagattttttttaacagcacccaggatggattattttttctggaatataaaaacggagaattccgttatatccgaaacaatgaggtccatcagagtctgaccggaatgaccaccccctcatggaagggaaaacgcctatagaagcaatgggcgatgaggtgggaagcgttttgcaggagggctacaaaaaatgcattgcctccggaaaaagcttgatgtacgaggaaactgtagaattcatgggaggcacccgtgactggctggtgcgcctcactcctgtaaaagaaaacggcgaggtttcttttattatcggatcccgcctcgatatcacagaattaaaaaaactgcgggaagataaggagcagctccttgaaaacttaaattccatgtttacggagcactctgcagtcatgctgatcattgacatgaaaaccgggaaaatactcaatgcaaacccatcagcctgcaggttttacggctacaccagagaagaaattttaaccatgcgcatacaggacatcagtgaatcgtccaatgatgccattaaactcatgcgcattcaggccctcaacaatgacaaaccttattcacttttccctcaccgcataaaaagcggggacgtgaaaatggtggacgtatattcaagccccattacctatgaaggggaaagccagctcttctccatcatttttgatgtatcagaccgggagaaattcagatatgacctatattgggacaatgaactgctaagcgttacccttaactccataggggacggggtcgttaccactgataatgaaggcaaaatcacctacttaaaccaggccgcccaggaaatcaccggctggaataatgagacagcatctgcaagaccttttgaggaaatctttgacttaagaaatgagactacaggagaggccatctcaaacccggtcagtgcagtgctgaagactggaaagatggtggggcttgccaatcatactgttcttttaaacagacagggggattttatccccatcacagacagcgccgctcccatcaaggaccagacaggccatgtgtacggagttgtcatggtcttccacgatgtaagtcatgaaaaaaggcagcagcgaaggatcatgtatttaagctatcatgattcattgacggaaattttcaaccgcaggtacatggaagaagaaatgatccggatcgacaaggcctccatgctgccgattacagtgatcatgggcgatgtaaatggcctaaaagtgaccaatgatgttttcggccacaaaacaggtgaccttcttttaagggaagttgcaaaaacatttcagcaaaccatacagaaaaatggggtcgcagcccggtggggaggggacgaattcctggtcctcctgcctaaaactgacacagcccaggctcagaagttcatacaaaaactggatgaagaattcaggaaaaatgaccgtcttcccttgcagctcagcgtatctttaggatttgacgtaaagcacagcgtttacgacaaccttcaccaggtactgcaaaaagcagaagaacaaatgtaccacagaaagcttttagaaggaaaaagctaccgaaaccgcatcataaatacccttttggccactcttcatgaaaaaagcatggaaacagaagagcacgctttaaggatcgaaacctattgcattgcccttgcagaaaaaatgaacctgtctcctgaagaaaaaaatgatcttgtccttttgtccatgctccatgatatcgggaaggtggggatcagcatggaaatcctgaaaaagaacggtcccttaaacgaggatgaatggaaagaggtcaaacggcatccggaaatcggttaccgaatcgcacagaacactccggagcttgtcactgtgtccgagtacatcctctcccatcacgaacgatgggatggaaccggttatcccagagggttaaagggtactgaaattccgctgctgtgccgtattctggcaattgccgatgcctatgacgccatgacaagcaatctggcttaccgcaaggcaatggacagccaggaggcaatggaggaaatcaagcgctgcgcaggcacccagtttgatcctgaaatagcccaattgtttctgaatctcaataaactgctcatggattaacccctttcacacagggaatatatacgagccgaaccaaatgtcctctttcctaataacatgttattaggaaaggaggcaatcctcatgaacacctgtaattttgacgggcttaccggtcgtgttgtaacgccagacgacccttattatcatgaactaagacaagtatataacagggcggtccaaaaatttcccctggccattgtctactgccgggatcaggatgatgtgatcaatgcggtcctgtggtcccggaagtaccacatctccctgcggatccggaacggaggccataattatgaaggctactccaccggaaacaacgtacttgacattgatttaagtgaaatgaaccagcttaccatagatgaagacgcccatttacttcacgttcagggaggcgtaacaaacaagcagttatatgaattcgtctcatcaaaaggttaccccttccctggcgggacctgtccatcggtaggggtgagcgggtatgctttaggcggaggcttcgggctctcctgccgctactttggacttggctgcgacagccttttggaaatcagtatggtcaattacgaaggccgtatcataaacgccagttcacaggaaaacgccgatttattctgggcttgccggggagccgggggaggaaattttggagttattatttccatgaccttccgccttccctcaaaagtaaataaagtcacactcattgacataagatatcttcactcagatcaggaaaagcagtctatgttcctgctgacctggcaggactggctgaaggatgccgaccaaagagtcactttagtttcaaggatctacaacgacatttgtgaaggccttgcaatcatcgcccgggggatcttttacggaccgccggaggctgccctggggatcatcgcacccctccttgaactgggcggcgtaaagtacagtttaaaatacgtgacctttctggaagctgtgacaattatcggggacttttatcctccctttgaaaaattcaaatcagcaagccgttttgccctgcgggactttaacagctgtgaaagctttaaattagccgggcttattaaagaacgggccgaaggctccgtttatgccagcatttccctttacgcccttggaggcaaggtcgcggaggtggatgcagatgaaaccgccttctactaccgcaatgccagctttattgtctggcttgatacggtatttgaagagcacaaatgcaaaaatgccgcctggatagctgagaaattcagttatttggaatcggttaccaaaggctcctatgtgaatttcccctatgcatgccttccctgccatcttgaagaatactacggcacccatgtctgcagattaaaaaaggtgaaaaagaaatatgatccgttcaacatttttaccttccctcaggggatcggtggattgtatggcacggattttacagctccaatatgctgtaagctctcccggtaaacctttgatacggcaaggcatgaatacaaaagccctctcgtgggaacaaatttcacgcgagagggcttttattgtatttttactatatattacttttcctgattatgactgttctggcctagaatctgatacagcagccggtacaaatccttaaactccttttcattcacaggaatacactggaacatccggtcagggatggttgcagcctggtcctttagccgctctcccttttccgtcagcgtgacgatcacgcttctctcatcctcctttgcacggctccggctcagcaatcccgccgcctccatcttttttagcagaggcgtcagggtaccgctgtccagatacaaaagctctcccattttcttaacggtgacctgctttctctcccacattaccatcatggcgatatattgggtataagtcagcccgatttcatcaagaaatggcttatacattctgatgatctcacgggagcaggcataaagaggaaagcaaagctggttttccagctttaatttctcatagtccatggtttctctcccttctcccatcattgttccctgttcgttttttcacaataaattctttacattttcttctacaagcttcatatcagcggttggttcaaaacgcctgaccacatttccctgacgatccacaaggaacttggtgaaattccatttaatatccggttcgtttttataattgggattaagttcttcaaatttctgctccagacgtgatgtcagcgcatgtccccgatcaaagccttcaaagcccttttcattcaccaggtaacggtacagaggaatggcgttctccccatttacatcgatctttgcaaattgagggaaggtaactccaaagcgtccggtacaaaaggaatgaatttcttcattgtcgccaggagcctggtttccaaactggttgcagggaaaatcaaggatctcaaaccctttgcctgcgtattcatcatacatggcctgaagatctgtgtactggggagtaaacccgcaaaccgtggccgtattaacgatcagtaacaccttgcctgcataatcggataagcttctttccgagccatccatttccttaactgtaaaatcataaacagacatctcatatacctccttatttactattgtattgtgcaaaatttaatttcctaaaactagctttatcataatacctgattgaccatttgtcaagagtattgtaaaatttaattgtacaaaattaaattaatctgtggatgctcctgttccatattacaaatggaacaaatatatatctttttcatggatcagcggtttttatgtgactcaatcacagacatttattcaatttttatttatactgaatgaaacaacatatgaccattggttatttaaaaatatagcaggaggtatattatgaaaaaaattgtgattatcggcggagtggccggaggagccagctgtgccgccaggctgcgcagacttgatgaagaagcaactatcatcatgctggagcggggagaatatatttcctacgccaactgcggcctcccctatcacgtaggcgacgtgatcaaatccagggatgcattactgctgcaaacgccggaagccatgaaacaaaagtatggcattgatgtcagggtaaaaaacgaagtttcctccattgaccgggagaataaaaaaatcacagtcagacggctggacaccggagaagtttatgaagaaacctatgataccttagttatttccaccggttcctcaccggtccgcccgcccattccgggaattggatcttcccggatccagactctatggacggttcctgacaccgaccggatccgggctcttattaaagaaagcaaaatcaaaacagcggctgtcatcggagggggctttatcggacttgaaatggctgaaaacctccgccatgcaggactttccgtttctctcattgaaatgcttgatcaggttatgacacctgtggactacgagatggcccagctccttcatgagcacatcctgcaaaatggcgtggaccttcatttgggcgatggtgtcgccgggtttgaagatcaggatggatctgtggccatcactttaaaaagcggtaaaactctttctgcagaacttgtcatcctctctatcggcgtccgtcccaacagtgaactggcaaaggcagccggtctttccgtcaatgagcggggaggcattgtagttgatgattatttaaaaacctcggatccggatatctatgccgtaggcgatgtgattcaggtggatgatcttatattcggggaacctgcaatgatcccacttgcaggtcctgccaacaaacaagggcgaatagcagccaataatattgcaggggcgcaggaaacctacaagaaaacccagggaacgtccgttgcaaaggtatttgatttagctgtggcttctaccggcgcaaatgaaaaggcattgatcaagaaaggcctccaaaagggaagggattatgaaaccatcatcatcacccagaattcccatgcaggctattatccgggagcagtgcccataaccctgaagcttcttttttccactgacggaaaaaagattttcggagcacagatcgtgggcctggacggagttgacaaacggatcgataccctggcagtggccatccgccttggtgcaggaatccctgacttaaagagtctggagcttgcttatgccccacccttctcctccgcaaaggatccggtcaacatggcaggatttgtggctgaaaacctgcttacaggaaaggttgcatttacatcctgggatgaagtggagcaaagcccggatgcggttctccttgatgtaagagaggatgcagagctaatggccttttccctgccaaatgcaacacacataccccttggacagttaagaagccgtttaaagggccttgatccttccagaaaaaccattgtcttctgcgccattggggtccgggcttacaatgccgcccgcatcctgatgcacaacggatttcgtaatgttaagctttatcccggcggtgccaggttctatcagtcgacccattatacggccgatggaattcagccttcccagcaagccgtttattcagacagcggtcagatggagactaaaaatatccctactctggccatgcgcctagactgcagcggcatgcagtgccctggtcccattatgaaggtgtttgaaaccatgaaggaaatgccccatggatcagtcatggaggtatccgcctctgacccaggcttttcccgggacatcggcgcatggtgcaggcgtacaggaaatgagctgatggcctgcgaacaccggggtaatgattacgtcgctttagtaaagaaaggcagcccggtctcccctgtaataaaggaaacggctgaaggaaagacacttatcgtcttttccggtgatcttgataaggtcctggcaagctttatcattgccaatggcgctgcagccatgggcagacctgttaccatgtttttcaccttctggggactcacggcactaagaaaggaagaaaaacagccggtccgcaagtcactgatggaatccatgttcggagccatgcttcccagggcagcaaaaaattaaaactttcaaagatgaatatgggcggcatgggaaccgccatgatgaaaaaaatcatgaatgacaagcatgtagattccttggaaactctgattcaaaaagccatgaagtccggagtaaagatcgtggcctgcaccatgagcatggatgtcatgggcatccggccggaggaattgatcgaaggcgtggagcttggaggcgtaggcgcttatctgggcgatgcggaggaatctaatgtgaacttatttatttagctatttggagaaagaaacatctgcattttgttttctattctgcatttctttatcaagcaggaggaggtaaccaactcttcctgcttgatttttcttattctcatcggcagcctctgccatagctgctgttttgcatatgtgaggtcttataatacagaaaggccagattttatttatgcaataaaaaccatttaaaacaaatatcttgacatattactaattataacctattattacctatataaaatacaataaggaatattaaggagtaaataatatgcaggaaaaatattattccgtagaccagatatcagaaatgttaaatatccatcctaaaacaatccagcgttacatcagggaaggtaagctgcgtgcaggaaaaatcggaaaaagctggagggtgaccggacatgacttaagcgtttttatggaaagtacaaaactatcaatcagaaaggaaaacacagataccgggacacaatccagcaatgagataaaagtgtcttctgtgatggatattgatgtggaaggaatggaggatgccatccgcatcatgaatactgtcactgccgcgctaaataccaacctcccggaatatggccatcccaccatgcacgcacagtttttggaatcagaaagcaaggtacgtgtgaccatatgggggaatattctgttcgcccaggcaatcattgaattaattatggaattaacagaaactatcagacaggatcatcttttataggaacgttacaatcaacggcacaaaaaacggctgcattcttatccctttgccctgacagtggaaatccatattttacagggcaatggcatatgtaccggatatggcagctttactttttaagaaagaaggaatcaaatgaatataaaaactatcaggaatcaaaatatcgctgttgttgataagggcaataagatagctgatgttcaaagtatccttgatatcatgtcttcggccggatatcaatataactgcattgggatgatcttatataaagaaagccttgatgaaagtttctttgatcttaagacagggatagccggggaaatcctgcagaaattttcaaactacagcttcaagcttggggtcgtaggggatttctcacagtataccagcaagagtttaaaggattttatttatgagtgcaacaagggaaatttaatttattttaagaacgacttagacagcgctctgtcagcgctggtaccggaataatccgtggaatgctgaaagaagacctgacagacacgtcctcttctcatataaattcaatcatcaaataaggaacggcggttttgaaatttcaatcaaaaccgccgttccatacttttccttaaagctcaatccctctaagcttaatataatccttgatcagcttcgccgtctgttccaaatcaatgcagctggtattgatgatcagatcataattgttccaatcctcccagctgccgccggtataatagcggtagtactccttccgttcccggttaatcctttttacgcgctttgtggcttccttctcatcaaccttatccacttccatggtgcgtctgataagggtttccgtatctgcataaacaaaaatttttaccaggcctgggaacgcttctttctcacggcccaagatgtaatctgcgcaccgtccggcaatgatgcaggactcctctgatgcaagctccttaatgacctgggactggaaccggaataaattctccggcttcacgatatccgcatccgtagagggttttccaagctgaggttttaaaccgcttacgatcttgtaaagcagattgcttcctgccttttcatccgccaggcggaaaaatacctctcctaccgcgctttgttctgatgttatggtcagaatctcttcatcataaaaatggattcccagctcttctgcaagggcttttcccacgattcggccgccgctgccgtattgccttcctatggtgatgaccagatttttcttttctttcataaatccccgcctccttctgccacacgttgtattctaactttttgttacttctattttactccattggggcagaatttacaattattattgtttcattacctcgttgaaacagatggctccgtaaggcctgatgctcatccggtaagcattgccctctcccatagctttctcaatgtaggaaacatattcttccaccagctcattgggcagcaaggtcatgataacaccggcaaatccgcctccatgtatcctgcatgcacctgtcttcttttctgccaggaaaagctccgtaagggccagggcaacggtaattccctgctcctggaagctggtattggtaaagcagttttgaagccatttccaggaagaattaccggattccgtgatatttttcaaaaaatcctcaaaccggttttcctttaaagcagccacctctgcctccacacgcttattctcttcaaagaaatgaagggcgcgaagtacggaacggtcaccggcaaaatccctgatttcctgtaggttgtcaatcacatccttttccgtgatctcggcacaaacctcttttccaaagaattcagcaacctttttcatttccgccgggacagaggaataatctgcacttaaatctgcatgaccctttccagtgttgacaatgataaggctgtggttttgggaaccgaaatcaaaatcaattctttccacaacaggagaagccggatccttaaaatcaatggtgatcagtccgcccacagcacatgccatctggtccaaaagaccggaagccttgtcccagtatacgttttcagagaacctgccaatatgggcataagccacggtatccatggcgctgttgttgaaaaatgtatttaaaatagagcaaagcagcatttcaaaagaagcggaggagctgacgcctgccgcgctgatgacattgctggtaatgcaggcattaaaaccgccgatttcatatccggcttccaaaaagccttttaatagcccttttaccagatcaatggttcctgccttcttatcgcttggagccaaatcatctaagtcgattacaaaactctggttataggtctcactgataatatttactttactgctgttgtttttcgcagctgcacccacacagtctaaattaatgcttccggccaggacctttccatggttatgatccgtatggtttccgctgatctccgtacgccccggtgcggaaaacagcatcacatcatcctccggaaatttcttctggaagttcctcacaaggctctgataacgttcaatgttctccctgaccgcatcttctccatataaagcggtcataagcttttctgactctttagactcaagcatctgaattgtatcgcttactttcatgttgtttgctctccttttccgatttaccgcccacactctccgggcagggcctacccagtttatcaggtataccaaaaaggtattcccccattgattgacaaagtattgtcattgctacgagtatatcatagatgccaaagatttcacaatataatattttatgaaaacctataaaataatttgacagctcatcccagggtcccgtataatgaaacaatcataaaaaccgcggcaaaaacaccctgcgggcatacctttatgcccaaaaagcgtgggcagaaaagaggaaacaccctgcgggcatacctttatgcccaaaaagcgtgggcagaaaagaggaaacaccctgcgggcatacctttatgcccaaaaagcgtgggcagaaaagaggaaaccatgttttggaacgacaaaccttaccattctctggattttgaattaaaaaagcagtatggccaaaaggtctataaactggctcttgacggaggcatgacctgtcctaaccgggatggaacattgggaaccaggggctgtatcttctgcagcagcggcgggtccggagactttgccgaatccctggcatcccacttttctgtaagccgccagatcgagtccgcccgtcaaagaatcgctggaaaaataaagccggaatccgcccgcttcatcgcctattttcaatcctataccaacacctacgctcctctgccctatctggaagagctgttcacccaggccatcttccatccggatatagcggtcctttccattgccacccgccctgactgccttcctcctcctgttcttcatctgttaaaaaaactaaaccaaataaagcctgtgtgggtggagctgggacttcaaaccatccacgaatccacagcagattatatcagaaggggatatgcccttcctgcttttctcaaggcttaccaggatttaaaggaagccgggttaacggtcatcgctcatgtaattttaggccttccaggtgaaaccagggaaatggccatggaaaccgtggattatctgggccatctggggaacaagggatcgacgggatcaagcttcagcttcttcatgtgttaaaagggaccgatctggccgaagaatacgaaaaggggctggttcctgtctgcactttggaagaatacgtggatctggtgatcgactgcatcgccctgctcccgcctcaggttgtcattcaccggatcagcggagacgggccgaaaaagctgctcctcgcgcctttatggagcggcaataaaaagctggttctgggcactctggcgaagcggctgaaagaacgaggcatctgccagggcgacagatacctcgtgtaagtttttttatgattttaattgccgttattgtgaaccacaccgttttcatccacagacaccccaaaggatatgccctggaaatactggtaaaatccctggatatcatcttcctggttcagcattctggtatatcctgcttttgaggttcccggaaccagtgacaatgtggtggttccctgatcaaaatccacgttagcccgtaaaagagctgttttcgggatgctgcttccaaaaatgaaattgccaaggctgtaacaaataggcttgccattgtagtattcaattccctgaagaacatgaggatggcttccgatcactaagtctgcccccgcatcaatgatcttcttccccaggaccctttggtattcctgaggtttctcatcccgctccactccccagtgaacgtataccaccacataatcgcagctttcctttgccttatttacttcttctaaaagaatggtcgggtcatagccgcttaccatgcctggctttttgctgttcgccacccaattggcatcgggataaacccttgatgcccccagaaaacctatggtttttccgtttacctccatggtttcaagctgtctggcccggttcatatcagggcctgctcccacatacttaataccggctccatccagggccgtacaggtgtccacgagggcatcggtcccataatcaagggaatgattattcgccagggtcacgatgtcaactccgatctcattcatcatggaaaccctggaaggggtcaggcgaaatgtaaactgcttgtccggcgcagcagagcccctgtcgctgaaaggaaattcctggttggccataaaaatatccgcaccgctgatttcgccttgatatccctcatccaatactccatttatgcttcctgcattatcatatgcagtggtcacatgactggatagtaatatatcccctgcaaaaagcagttgagcggctggtttttgtgatccttcttcctgggttggagaggcctcctcctgagactgggtgttctccagggtcagtactcctgtttcctgtgatggttcaggctctgactgggtaaggctttcactggaaacagcttctgctgcaggcatcttttccccctgtttttccttccattcacttactccaatccacccaacaagtaaaacaaacagcaataggggaaagaaaatcagaattttcatcagcccattgtttttcttcatgtattcctcctgattgttgacaatttccacatgattctacatttttcattactttttccacagtatcataaggttttccataacttttcctttatgcttctgtgggttttatttccatttttttatcttacactggttctgtggatttgtcaaacattctgctttacttattatgaaagctaaggatataccggaagcaacaatcatcctggcaccacatggaaaaatttgttccccatttattgttaaacagacagaaggaaaaacccttgttcatatcaggaagttccagacagccgccatacagcctcctgcctcccgcactcaccaggggagaatcgggattccatatttctatggttccatccgccccgtcatagaccagtttttccgcacaatgctgcctgcggtttcctccctttaccacttccagaggagagatttcctgatccatgatcttcattttccaaaggcatgggttttccacatcaatattggcatcaaaccaaagagcttcgggcattttatttgcctccttattttcccatgaaagatcacataaaagctcagttccaaaggtgtaggtgatccatgctccttccgggcagccatattctttcactgctcccggatttcctgccaggcggatcctcaccagggaaccggattttctcatatcccgcaccccaaagggataattcctgttggaaagtccctccacggtttccagtccgggtttggaaaaatctgcttccgaccaggtcatattttccttaaatgcgtggttgtactcataaaattccgataccgtatccaaggccccataggtttcataagaaaagcggccaaagcagcctgactggatccagacctttccgtccttttccagataaatcacagtgccgcttccgtcaaatgccgctttccagttctgtatggaaatgatctcaaagggatggaccgcctccccctcttcccatatcttctcccctggcatgggattccatataagcgcctgccctgcttcctctttaagctcctccggaagcagacggactgcttcatttaagtactccctctgttcctcataggagctttcataccgttcataggtgctttctaaatgatccaccccctttccatgtatatggcatgtaaaagggctgcatttctttctgtaaacatggcctctgtcacatggttttcttttcttgctctcttaaagtcttcctttttccagttttcaaaatcaaacaaatgttttttataatcaagcccccaggtatgctcgcataccatcagcaggttttccataaaaccttgaaactccggcttttcaggagcaaatttcccttgttttttccactgatccttaaggcccataagccgtctgagtcccctgactttgaccggatccgaggctatgccgtgaatccaggtatcccgatttcctcctttatcaccggaagctcttcttttctttcccaaagcttttgggcataggcatctaatgtggaggcctccaccctggcgccgggatacttctcttccaacgcctccaattgcattaaaacttcttccctggtgggaatgcccagattgtcccccagaaaaacaaactccagaacatcctccattccattcacataacaggcagagccataaacagaggaatactgaacaaggatttcactgcctgctgactgccacacaaagcttttaggaaccatcggattcatggatgaggggtttactccgatatgtaaatactgttttccatggcaggccatggccggtaccatggccttcgtatggcccggtacgtcggtcagctttgcggcaatggtctttttcccaaactgccggtccagcatgtctgaatatgttaagttaaaatccatcagatcagtatccatcagttccgcgtgagtggtaaaagccattccatgccagcagatgtctcctctttccacggcatccttcagcctctgtgcctccgcctttccggccttttttaagtacctgtcaattaaaaatgcccccagggtccagacaaaccgtttccttccatcccggtttaagtccatggcaagcccaatggcttcaggaataaaatcgtgaatataattggaaaggacacggtccgccagatccgtaaatcccatatcaaaatgtgtcataaaaaccacgtggacattcttaattgttgtattagtcattgattcattctttgtcatttttttcacctgttatatagtaaggattagaaaggagcaccggaatattaaggcgtcctttaaaaaggttccgcctgatctccgcccgaagatatcccggctctcctgggattctttcaatagaaagatggtctgattcacagaggatctcctctctgttgtcctgggaaaccaggaaaagggtatcgccctttattaaattccggaaggtaaaccttatttcagtccctttagggatctcatccccaataagactctctcctgcccaggtatccatcatggggccttccggtgataaggtaagaaaggaatgtccctttttaagtccttccaatatgtcctcagcggaatttgacagcgcgtacacacaggtacagggagaggcaggcatccttcccggctcatatttatggaaatcactgcctcctgttattgggatcctttttccttccttcagcctttcatcccaccagtttaagcatttctggttgctttccggttccaggcctccattccatacttccaccccgtcaaacggaatttcctccattccccatttccagccgcaccatgggcagaaggggtggtttattaccgtaaaggctccgtttccccttgcttcctccaggatttccactgttttttccaaagaatttgaaataaaacttttaaacgggcgtttccttcccagcattcccatatggcctttataatgggtccattccacccccggtatcatggtcacctgttctgtagagcgcagatgatcattatgtgcatagttattatgatccgtaacaaacagaaaatccagctcttctctttcagcagcaagggccagttcctcaggagtcatgtttccatcggagccgcaggaatgtaagtgagtatctcctttaagcagacggaggtctttccattggtaagtgaccttatatgtaattgccgccccctgttcctctaccttataggctcccagaagtatgctccactctccctgttttacaggaaccgatgcaaacccatctgtgctcctgtgatcagagatgacgacccggtttcggttggagccggaccagccgatcaattctcccttttcatttaacaggccgaaatctatgatgttttccttccggccgtattcgtatgatacctccatggaagcaaccatatccggtacggaaaaggggatttttatatacagcccttcttcctcttttgcagcaaccctttgaaatgtaattgttttttccttcatgtcaatcctccatcagcccttaacggctcccatgttgatcccttccatcaggaatttctgggcaaaaacataaatgatcagcagcggtatggtggaaatcacgattgccgccataatggcattatccggagttgcagccgttccggaggtagaatctacggacatgatcatctgtttcagcatcagaggaagggtatactttttctcatcagtgatcagggttgccgggagcatgatggaattccatctggctacatattccataaaaaacacggttgcaaatcccggcagggatataggcatgtatatgcttccgaaaatcttcaattcccctgccccatccattctggctgactctgcaagggaataagggaccgtttcaaagtaattcctcatcatcatgatgctgaagcctgacaccagcccgtttaaaacaagtccctgataagtatttaacaatgacagctgcttatttaactggtaaacagatatcagggtcaagtctccgggcaccatcatggtgagcatgatgaacgaagaaataaaatttttaaaaggaaggctcttttgtatcagaacatagcctgcaagagctgataaaaggacctggatcaccgtgcctgtggtggttataaaaagggaattgagaaacggccttcccattttggccacccggaatacataaaaaaagccttccacactgaattttgaccaccacagcttgatcccgctttgcgaggagtcaagagccgttgaggttgacaccacaaatacattccacatgggaagaaacatggtaagaaaaatgaccgctgtcaaaaacaaaaaaagcgctctccagaaacccgtcaaaccgtttttacctagattatctttcatatctttgccctttccatcaggaataaatttcatcatatttcagcacttttctgactgccgaggtgatcagcagagtagcgatcaaaaccacggtagcagccgctgtagcagttcccacattaaactggataatgccctgttcatagatcagaaccagaaggtttttcaccttatcactgatggaggcattcatcataacaaaaatctggtcaaaatttctcagaatccccattaccgacagcaccgccaccaccttcatggtgggaacgatgaccggcagagtgatatagcggatctgtctgatccttgtggccccatccattcttgcggattcatacagagccgaatcgatcccaatcatggcggccaggaatagggccgcaaaatagccggcccctttccaagcacctgtaaaaatcatgatagttctggcataacgcccctccgccataaataccaggggagaataactgtttcccaaaacagccctcataatgccgtttaccatgccagcaggtgataaaatggagatccacaaaccgcccaccacagaccaggacagaaggtagggtatgtaagtaactgtctggaacagggatcttggtgcctttttcctgacctcattcagcaatacagcgatcaaaagtccccagacaaactgtaaaacaaaggttcctcctcccactgcaaggctgttgacaaaggcctgcctgtactgcctgtctccgaaaatctccaagtaattgcgaaatcctaccagctcataacctcccagaagcttaaccttctgaaagctttttaagattcccagtaccagcggatagtaggaaaatacaagaaagtaaatgagaacgggtaccagcagcagatagatctccttatacctcaatatctttttcttaagctgtcctttcaaaccgatgcctcctgtctattctgggaattgtgcttaccggtcggtcaccttccggtcaacaagctcttttctcatgccgctgagtccatcagcggtggaaacttctcccttgatgatcttgattccccatttgcctacgatctccttataatctgcttcatttgggatgatcatgtcaatggttgcgtaaccgctgtagcttaatgcttcctccactcccggattgaatccgaaaatcggcttgaaatccttataaatcgggaatggagcgccgtggtcattgccgtgctgtgcgcctgtctccgttaattcatacttgccctctgtaccggtataatcatggcctaaaattccggttgagagaaggtttcctccttcctgtgtggcaaaatactccagaatctttaaggctccgtcaggattttttgcattggccggaactgcaaacaaactggcgtttcctttgaccagcatatagcttccgtcaggagtcttaaggccgggaagagaaacgatttcataatcctcaggagaaattcccgctgccttggcatttgcattatgtaaacctacccatgccgtccagtcggctgtcacagctgtcttttgtgaggaagctcccattttggctctcatatcctttgttttatcaacaaaggaggaaggatccatcagaccgtcatcatacagctttttaaaccattcccatactggcgcggcttcatcctctgcatagggcgcatatttttttcctgagtcgtccagaaccactccatcctttaagcctactgctgccatccagggctgtaagtcccaggtctctgataaaatggaatcaaatgggtaaaaatccggggcctggttattgtccttcagcttcttcatcacatcataatatccgtccatggtgggttcgatattcttataatcgatcccggcctttttaagaagggtgttgttaagggcaactacccgatggatctcctttttgttaaagcctgcgtagacctttccgtcaatggtaatatcctcccactcctcaggatccacattgcccgtaaggatctccgaacctttcacccggtccgtaatatccatcaaggctccctgatccaccagattggcatactgacttgcagtgacatagatcaaatcataggtttcgccgccgcttaatttctgcatcagaactttatcataatctgacgcaggcttttcaatttccacagtaaggcctgtagcctgggaaagagcctctgcaaagagcttcatctcttcctcatccttgcctcccgtattggctgacatgattcttacggtgcccccgctcctttatccgcctgtccggctgcctctgtcttgccttcttctgtcttaccctcttctgtctggcttttttccgtctgactttcctttgtgctggcgctttcctgatttccgcaggcgcttatggagcacaccataagggccgcagcaagcagtgacatgactcttctttttttcatttctttctcctttcgatccgaaactcatttggcttacaaaatcatattatattatgtttttgattttgtaaatcatatttacacaacttttacatatattttaattaaaatatatgttttgtgcatttataatatcatataccgtttttattttcaactgtatatcggtattttgttattaaatcacatattttatcaaaattttttatatataattactaaaacaaaaaaagaagcgcagaacaatcataaatattattctgcgctccaatgatatgaaaggaacaaatatatgttttaatactcacaaaatatgccggggaccagacaatccatctggctgtatgaagaatccttttccacctgctttaacaggatcctgatggcttcaaaggcaattttcttttcatcctgctttatatgagtgaaacgggggcctccaggtgataaataatcttcgtcaatacagcatacggttattcctttccggtctccaacccacctggcaattccatattccgcacagatgaccgcatccagatcctgattctcacttaagtactgaccgatggtttcgccgtactccgtatcaagatcgtctgaatagatcttgattttctcggagtcctccaggcggcattccgccatattttccagccccgcagcctttatggcctctaagaatccctttcttctgtccttaatggaagaagtatcgttttccgaaaatgttataaaaccgatctttttatttcccttgcgcaccagatgctccaccagctccttcatggcaaggtgattatccgtccttacagacggaaccggaatgccctccattttcttatcgatcagcaccatgggaaattcttcaatgacaagctttaaaattgccgtgttataataaagtccatggcagggcatgacgatgatcccgtttacaccaagctcctttaaaaactcgatttcttctgtctccttttccctctcgccgtaggaaaaacggacgcacagcttgtagcctgcctcagacgccatggcatccattgcatacatcatgtcaaggccaaagcaggaggatacatgctccaggaccaggcccagcatccgatccccttccttatcctcatattttatggatacaccgtcaaagctgcctgaaaactgctccgtttcttcggccggaagctgtacaaagcttcccttacctttgatgcggtttaagtaaccttccattctcagggcatttaaagcattggtaatggtgatggtgctgactccatatacagacgccagttcaccggtctgaggcaggcatgctccttctgccagttctccagtgaggatcttattttttaaatccacataaatctttttatataaaaattgttctttttccatttgaacctcaaaattctgtatttttatatattatatcttttacctctgcttttttcaataaaaatatatttttctttattaataaggcagacttttctgctttatctttttcctaaacttatttccttttcccatggtctgggatttcacccttttaaaagataaaaaccggcctgtcagccaccataaaaagcacctttccgggtccggaatatctgtgaaatatccccgtcttttcccaaaaaggtgctttctccccatattcttctttccttacatgattcccaggctgcttttacggcctgtgcttactttaaagcagcgccattggtttcgatcacatgcttataccatttaaaggactttttcctgctgcgctttaaagatccctttccttcgttgtccttgtcaacataaataaagccgtatctttttttcatctctccggttgatgcactgatcagatcaatgcagccccagggagtataccctaataaatccactccatcctcatccacagcttccatcattgccttaatatgctcttccagatagcttatccggtaatcatcaataatacttccgtcctcttccactttgtccacggcaccaaggccgttttccacgataaacaacggcttttgatatctgtcatacaaggtgttcaaggtgatcctaagtccaaggggatcgatctgccacccccactccgatgcctttaaataaggatttttaatgctcttcatgacattgcctgatgtggattttaaaacaacctcttccgatgtgctggcgcaccgggatgaataatagctgaaggaaataaaatcaaccgtattttctttcaggatttcatagtcttccggccctgtttcaagctttatcccttcccgttcaaacatttttctggcgtaggccgggtactcccctctggcctgcacatcaataaagaaataattatccctgtccttttttaacccttcccagacatcctccggattgcagctataaggataaaagtttcctgctgcaagcatacagcccactttaaaatccggattgatccggtgggccagtcctgttgccatggcagaagccaccagctcattatgggcagcctggtatttcacctgtttttcatcttctccttcggagaacaggattcccgcccccataaacggcaggtgaagaagcatgttgatttcattaaatgtgatccaataggtcaccttatcccggaagcggcggaaaatggcatcgcaatatctcataaaacaatcaatgaccttcctgttcttccaggaaccgtatttttcaacaagggccaggggcacatcaaaatggcagatggtcaccaccggctcgatcccatactttaacagctcatcaataaaatcttcgtaaaacttaagtccctcttcattgggcttttcttcctccccggtagggaaaatgcgggaccaggaaaaggaaaagcggtaacacttaaatcccatctctgcaaataaggcaatgtcttccttataatggctgtacatgtcaatagcatctctggaaggataataagagtcctcagacagctgccggtaatccatatctccccgcataaccggaaaacggttttctccccaggggatcacatccacggtccccaatccccggtttccttccttccagccgccttcgcactggtttgcagcagtggctcctccccacaaaaagttttctctcatattttccatcctttcttttttatgatacagctatgagaaactggtttttcagcttctcataaaacgtactgtttgttattaccgcctgtccggctccggaaatgccccgtccggctgattaaaaaacattcttttcataatattgtaatcaacgcatctcccggatcaacttctccgtcatctgtggcgatcacatcagtaaatgtatcagcattggaaaccagcacaggagtcaccagggaataccctgcctcccggatggcttccacatcaaatctcagcagctcctgccccttcttcacgtggtctccaactgcagtcaatacggtaaatccctttccttccagccgcaccgtatccatgcccacatggatcagcacctccgcgccttcctcacttaccattccgattgcatggcctgttgggaaaagagcggtaactgttccgtctgccggagcatataaaacgccttcctccggcaaaacagccactccccgtcccaatgctccggaggaaaaggccgcatcctctatctggtccagctgcatgacttttccttttaacgggctggcgagagttatttttctgactcctgggtttgatgctttaagctgtccgcttttgacctcttcctttgtttcatcccggtacaataaaaaacagatgacaaaggcgatggcagaagccacgatcacgcctgcggctacccagggaatgctggaggtgtcattgtttgccggattgataaaggtcacaaatccgaaaatgcccaaagcgccggaggaatatttctttacatttccaagtccaatgatggctcctcctatggccgctccgatacaggagatgataaacggcattttttttggaagggacacgccgtaaatagcaggctccgtgactccaaagaaaccggaaattgctgcaggaatacaaaggccttttaaattcttgtcctttgtccttatgagcacggcaatgaccacagccgtctgcgcaaaggaagcggcaaagtacggctgcataaagctgtcatatccctgggtgcttaaattcatgatatagatgggtatcagtccccaatgcaggccaaagataacgagcacctgccagaaagcgcctacaatcaggccttccagaaccgggctggcatcataggccgcctgagttgcaaagccgatgacagctgcgatggaattggctatggggccgacagccacaaaggtcaggggagcggccaccagaagcgtcagggtgggaaccaggaagttctttatgacgtcaggaacaatccttttccacatcttctcgattttagacgcagcatatactgaaagcacgatgggaacaacggaagacggatagcccgcttttggcatgatcaccggtatcttcaaaaaggtggcataaacgttggattcaaacatgctccctgcaaacaggacattctgcacctcatttgatgtgagggccgtgatcttcggataaatcagggcgcaccccagcgcaatgcctgtaaagggatttagcccgaacttccttgcagacgtatatccaagaatcaccggcaggaagtaaaagaagccgtcgcccaccgcaaaaagaagctggtaggttccgtctgccggagacaggatctttgtaaaggtaagaatcgccagaattcctttgatcagcccggttgcacagaatacgcttaaaatgggctggaacacgccggaaagggtatccagcagcatggctgacagggagcccggcttgtccggtttctccccttccgaatcagaggaatccccttcaaagcctccggcctcacacacggctgcatagacatccggcacatgattgcctatgactacctggtactggcctccgcttctcataaccgttacgattccgtcggtcccctttaacacatcggtatttgccttagactcatcctttaatttaaaacgcaatctggtgatacaatgggtcagactgatcacattggacttcccacctacattctggataataattttcgctaatccatcatatttacttgccatatcttatcctccttgtactttttgccgcaaagcttttcatccggatttcataaacctttgcagctttttataaatacattccaggattggccttctcccgaatgatttccgtccttttatttctcttcctctccatgctcctgcatgatccttttgatgtgaacagtcagatacatgatttcttcatcggtcagctggtaattcattttcttttccatatatgtattcacctttaaggcacactgatatgccggttggtactggcggtagatcatgttgcagaattccagatcctctgtcccgtaataccgttttttcacagcacgctgcacgaaaaattttaaatgggtcacaaatctttcataggacagggtttcttcattaagggaaactccgaaatgatagcggacgatgtttaaaatatcctggatcatctggggaatctcactggactccttcatgttcgtatccagttccgcatttacgatgtgcagcgcaatatacccggcttcatcctccggcaactcaacaccaagcctgtcctttatgatctgtaaggcttccagtccgacctgatactcctgatgatagaattttttgatttcccacaataacgcatttttaaattcaattccctgcttttttctttcaatggcaaaatttaaatggtcggtgagggtgatataaatgttatcattcatttttctgcccaggttttcttttgcataagaaatgatcctgcccgcacattgcatgtgggcttccggaagctttgataccagctccgcaaactggctcatttcccgggtttttaaaaagaaaatttttgatatcttcgattcatcgatgggacttcccggttttactgaaaaaccgattccctttcccatgagaaggatttcctttccattggaatcccatgaactgattatattatttcccaacacctgcttcactaccataaacttccccaacttcccaaaaccggttgtaaaaagtgtctccgacactttccttttcccataacgtaaaaaactggtcatatttacaccttgcctgagcaaaagtataaatataaccagttatgcctgcacaattcattacagttgcacctagtcagttcttttattatgtgcatcttaacatatttttccaaacttgtaaagcatttattatacactttttaaagagtcataacgattccgccgtcattggcatataccgtagcaactcctgctgtttctgctatgatcacatccttgaacctggcctgctttaacatctcctgccttacatgctccgcccgcggccggttgttgcagtgggaaatgaccagaaccttatccctggtatctcctgcatccttgatggcaagctctaccatgcgcgccagagccttattgatccccctggcctgatccagcttaatgatcacgcctgaagccgcgcccatcaccggtttgatattcagggcagtggcaaaaaaggcctgaagccctgtaaggcggccgttctttcttaaagtgtccagactttccaggacaaaataggttttcatattcttgataaaggttcttgccttctcctcgatctcttcaaatggaagggaggcctggcaaagggattggacgtaaagagcgatatttaactgtccggcagaggccgaatccgaacctagaaccgcgatctttttcccgtcattcccatgttcttcttcgtaaagcttttttcccagaacagcgctgttatagcttccgcttaaatgctcggacaaagtgatcacaaaaatctgatcctcatcacattcataagcttctttatacagctccggtgacggacatgctgttttgggacactcactgctgcttttcaccagctccagaaagcttttctgatcaaaggtctcatcatcgataacctgagtatttcccacttgtaaaataaggggaattatctgaaagtgaggatctttttttaaatctgccgtaatatccagacagctgtccccaatgattttatagctcatatctctatccttcctcctggcatgaaacttatcatgtagtattcattaccatatattatagagaaaccagacccggatgtcaatagaataatttaacactatccgcttagccataagaataagtcttatattccaatgatttcctaattaatgcagaaaaaaggacctgtaccagaaacttccaaagtacaagccctcattagtacaaatcctcattctaccgccggatattaatcctcttgaacatcaaatactcctaccgcacttatgctggaagccactacgactacgacaacaaacagaatcagaagcataattcccccaaaaaaagtcattataaatgacatcccgttatcttctgaagccccttctgccggtacagcggcctctgaaacagcaactgtctctgcgtgagcaaccaatgcagtgccaggtgcggcacctgcaaacaggcccagcataagaaccagcaacaggcgcatcattcctttccttatcttcatcgtcttttccttcattaccgtttctcctttcaatgcccgtgctatttggacacatggtacatgtccggtcaagcggggcaggtccccatagggtatttcctccctgccaataaaaaatcactgtatctaatatagcataaccgggagaaaaaagatatccccaaatcataggattccggtttttatacctctgccatcacaagcatcagatcattgcttctggcaatgaatttcgtcatgcgttccggtgtcagagagccatggcttaaagctgccagatcataaagctgttcgcagatggcatttgtatgagccccgtctttgtgacccagcacatatttcaccagcttattgttgtagttaagcaccaaagtctcaccgcctgctccaaacatggaaggatccattccaggcatggtgtacatcttcatcatttcctgcatacggcgggattcctcagatacggtgatcatggaagatacattttcattctttaatttctcaaccttgacctctaagtgttctttgtccaatgccttgcggaacagctgggtcagggcctctgtatctgccttcatggcttctttatcctcttcctttacctcttccttaaagatgtcggataaatcggaatttatgcataagaattttacattctcattcttctgttccagatagcctacgaacgcgctgtcaatattatgagtcagataaaccgcatcaagacctgcctctttaaacatgttgatgtactggctctgctctttttcatcagagatgtagaatacgctgttctcgtgcttctccttattctcctccaggcaatcggaaagagttaaatacttgccttccagattcttaaagatgagggaatcgttgatcttttctccgaacttctcatcctttaagcagccgaatttaatgaatggattgatgtcatcccagtacttttcataattttcacggtccgtcttaaacatgccggtcagcttatccgcaacctttttagtaatgtagtcagaaatcttctttacaaaaccgtcgttttgaagagcgcttctggatacgttaagaggaagatccggacaatcgatcactccctttaacagcatcaggaattcaggaatcacttccttgatattatccgcaataaatacctggctgttgtacagcttgatagttccttccaggctgtcataatttaaattcagcttggggaagtagaggattccctttaagttgaatggataatccatgtttaagtggatccagaacaaaggctccttgtagtcatggaacaccttgcggtaaaaggatttatactcttcttccgtgcagtcgtttggatgcttgttccacagaggattggtatcattgaccggtaccggacgctttttgattttatatttttccttggcaggagatacctctacgatttccttttccccgttttcgttctccttttcctcagtctttgcttcctcaatgatggtttcgatgatcgtatccttatcagtcagctcatccttttcaatggtctcatactgaggttctgaagatgcgctggataaataaattgacacaggcataaaggaacagtatttctcaagaacttcttttccccggtattcgttgcagaattccaggctgtcttcattaaggtagagtttaatggtggttccaaactcagccttgtccccttcttccatctcatattccgtaccgccgtcagactcccagtgaactgcagcagccccttctttataggataaggtatcaatggtgaccctgtcggctaccatgaatgcggaataaaaaccaagtccaaagtggccgatgatctgatcttcgttggctttgtccttatatttctcaaggaaatcctgagcgccggaaaaggcgatctggttgatgtactcatccacttcctccatagtcattccaagaccgttgtccttaaaggtaatggtcttttcattggagtcggtaatgatctcgatcttaaattccagatcctccggtttctgccactcgcccataatttccagcttcttaagctttgtaatggcatcacagccattggacacaagctcacggtagaaaatgtcatggtcggaatacagccatttcttaataatagggaaaatattttcgctgttgattgttaaacttcctgtttttgccatatcagaacactccttactcttttttctatttcgcttccatgttcccatggaattctcacaaatttgtataccaaagaatattttaatacgctgttgtggaaatgtcaatagaaaatcagcactcatttaacttgagtgctaataattctattcctccagaaatggaatctcgttgcgttttaaaaaccctttaaatgcctggtcccattccccatccagggtcttgtccagagtaaagacagagacagaggtccctgttacgcaaatgagtttatcctcctcataacggatattgatgtacagccccttcacctgatcagacgtaaatggaatctgacgggaagcaaggaaacgctctgtcccctcctttgacatctgcagaatgatgcggaagctgatggggagcctttttcctttaattagtgaaaaacaaaaaggcttcatcatggcccaggtggaaagctgtccgattttcatttcctcctgttcctccctggagtagtatccggaacgcacagttccgtcaatggtaaatgtattaaaggtagcaatcacagcttccttagcaagaaactgatcaaacacttcccctacaaacagcttggaggttaagagcttaatgtcctcaattttcagcgcaatcatggcaaattctccccattttataatctttatccgttaactatacaccgcaacctcccagactgtcaacgcaggatttcccaactttccccctctccccctattccaaaacatcttattctgtggtatattatccacgaaagcaatgagcagggcaaaacaggatacgaaaagtttttcgtcgtgccccgcacgtaagaaaaacttttcgtaccctgttttacagggcgactgcccgtgagcgggtgaatccaaaggattcacccgctcccctgcggatctcacctccaaaacaaacaccacacccagaaaagaggccccacatatgaatcacatccaacaattagaatcactgatcgccgcatcagtttccccctaccactgcatcacagcagcatccagccagctttcagccgcaggtttcaaagaacttcccctggcttccccctgggagctgacaaccggcggatcttactacataaatgcctttgattccacattaatcgcatttaccataggaaaagagctgagtaccccccctacccttaagctggctgcctcccatacagactggccatgcctgaaggtaaaaccctccccggaggtcacctctctcaaatacggaaagcttaatgtagaggtatacggcggcccccttttagggacctggtttgaccgccccttatccatggcaggaaaagtctgcgtagccggcccgtctcccatgaagccaaaaaccatatttgtggatttctcccgccccctcctcacaatccccaacctggccatccatatgaaccgggatgccaacgacggggttgccatcaatccccagatagacatgcttcccctcattgcccgtatcacggatgagttaagcaaggaagactttttcctggaagccctggcaaaagaggcagccgtaaaaaaagaagacattctggactatgaaatctgcatctataactgtgaaaaaggaactctattaggcttagaaaacgaattctactcctctccccgcctggataacctgacatccgtgcaggcctgcctaaacggaatcacaacaggaccgagcaaaaacggcatcaacgtcattgccttatacgacaacgaagaaatcggaagccacaccaagcagggtgctgcttccgccttgatggaacgcattctcgaaaaaatttgcttatctcttggttactccagagaaacctttttaaatattgtgttaaacggctttctcctctccctggacgtagcccatgccattcaccccaaccacggagaaaaatgtgacattaaaaaccagatcctcatgggagacggcgttgccattaagctggcatccagccaggcctatgccaccgacgcttccagcaccggagtcatagaaggaatctgccgcacaaatcatattccttataaaaagttctccaaccggtctgatatgaaaggcggctccactttgggaagcatctcttccgcccttctcaccatgcgcacagtggatgccggggtgcccattctggccatgcactccgcaagggaagtcatgggaaccaaggaccaggaagctcttgtaaagctggcagaagccttctttcaggcataatcttaccgttcctgcccccaaaagagaacatccaccatatcccccgacgaaataaccgttccctgtttctggtcaatgatgcagtttgaacggagcattccggataaaacggaggaatggtggtttctgtcaaaaatatggacacctgcctcatcacagaaggcctggacaaaccgcctcttttttgcctcattggcgcttccctctgtcaccacgcgccttgttttcttccaggaaagagagtcatcgcccataagccttgccagaaccggccagaaaaacaactggaaattgaccatggccgcaaagggatagccggagaagctgagaatcagcttctccttataccggttagccataacaggcgtgcccggacgcatattcactccatggaacagcctttctgcaccgatttcctccaatgcttccggaagaaaatcctttttccccacggaaagagcaccggtggtaataatcacgtcagcctgaccaattctctcctccagcatgcgggaaaacgcattagagtcatcaggacaaatctccataaaaggcaccttgactccctgggctttcagctgggaagcaatggcataagcgctgctgggatatacccctacctttcccaaagggccggtgagagggacaagctcattccccgttgaaatgatacccactccaggctcccgaagcaccgtaatttcccggattcccatactggctaaaacaccgatatgccctgcgcccaaacgagactgtctggggataatgcaggttcctgcctgaatgtcctctccgatcctgcaatagttctgccagggacttccctccacatatacctttgcctgttcctgtccatagtccgtatcttcctggcgtatcacacagtcatagccctccggcaccatggctccggtcattacccggaccgctgtacaaggctttgcctggatggaaagataatcccctgcgcatatttcaccaatcacctgaaattgaaccggagtttccctggaagcgcctttcgtatcctgacttctgaccgcatacccatccatccctgatttcgggaaatggggaacagagagcggggctgtcacatcctccccacaggttcttccaaaggcagataaaatgtccagcttttctgttttcatttctatttttgcgctgttcaccagcagttcaacggcttcttctaattcgatcaatcaggctcctccttcctcttgccacattctgcagaaaaatttattttgcagcaccgctctctttcatgataagattaagcgcgttttacagataccgcacacaccttgtattccggaatgcgggcaatatcatcaatcacaaaattcgtgattctgtttacatttccgtctgcgaaatggaaggtcataaatacttcggaaggcatcatcttatctcctaccactgccctggtttcaatttcaccccggcgggaggatactttgaccttgtctccgtccttaattcccagagtggcggcatctccctgattgatttcaatataggagtctccgcagatttcatttaacccttccgtccggcctgtcatggctctggtgttgtaatggtagagcatacggcctgtgaccatcagaaacggatagtctttgtcaggaagctccttggaaggccggtactttgccggataaaaatatccaaggccacgtgaaaacttccccacgtgcataatataggtacctttgctctccttatccaggcagggccactgaagcgtctccccgcggtccagtctctcaaagctgatgcctccaaaggccggcgttacgccggcgatttcgtccatgatctcagacgctgtttttctctcacaggaatagcccattcggttcataacatcgtaaaagacgtccgtatccaggcgcatttctccttccagagtcaccgccttgcgcaccctttgtacccgccgttccgtattgctgaaggtaccctccttttccccataactggttccgggcagaatcacatcagcaaactgtgccgtttccgtcataaacagttcctgaaccacgagaaactccaggctttccagggatttggctacatggcctgtatccggatccgtgaccatgggatcttctccgaaaatatagagccccttaatcgttccttcaatggctcccggcagcacctgggtggacatgagtcctgtggtttcacttaagggaaccccccatgccttttcgaacttttcccggatctccttgtttgccaccttttggtatcccgggaaatcataaggcatgcagcccatgtcacaagctccctgtacattgttttgcccacggagaggattgataccgcagcctgattttcctattttcccaaccgccatggccagattggaaaggctcataacgccctctgttcctgtggaatgctcagtaacacccagacagtaaatgattggagcctttttagccttggcatacatccttgcggctttgcggatatcctccgcatcaatatggcagatcttggcaaccttttccggagtatagtccttcacgatttcagccagctcttcaaagccttcggtccgctcctttataaagtccatgtccgcaagtccttccttgacgatgacatggatcattgcgttggcaaatgcaatattggttccggctttgatgggcatatgaatgaccgcatccttaaccagatcaatctttctcggatccactacaatgatctgcgtccccctttggatcgcctgccggatctgggcacctacaaccggatgggcttcggtggggttggaacctatgagtaaaatcaggtcaacgtcttccgtaatatcctggataggatttgtcatggcaccggagcccagggtcgtggcaaggccgtggacagaagcggaatgacagacccttgcgcagttatccacattgttggtgccaaaggccgtccgcatcattttctggaaaacgtaattgtcttcattgggcgcccgggagcaggaaaagccggcattggcatccgctccatatttctttttgatttccgtaaaccggcgggcgatcaagtccagagcttcatcccagctggccttttcaaatttcccttcccgtttaatcaggggatgagtgagacggtctccggaatgaatgaatttataggagccgaatttgcctttcacacacagaagacctctgtttgacggtccgtcagccggatcaactcccacgatcctgttgtttttcactagtaaatccatctggcagcctgtggcgcaatgaggacaggtggtccgcaccttttcaacctcccattccctgtaatgcctttgctggtccttggaggagagcgctcctgtgggacagtttgacacgcagtttccgcaggattcacaaatggattctctccagggaagctgatagctggggctcatgcgggcatcaaagcccctgttggaaacgctgatgacatcccgaccctgaagctgctggcatactctggtacaacgccggcacatgatacatttttccggatgaaaggaaaaaaacggattgctgctgtccacttcattcatccctaccctttttccaaaggtgaagctggttttttccacaccgtattcaaggcagtaatcctgcagcctgcaatccccgttggctgcacagctgaagcagctgagtacatggttgctcaaaagaaggtccaggataaaacgccgggactccaccaccctctcagacctggtagacaccttcattccggaagcgcagtgctcggaacaggatgggaccagccctccttttcttccgccttcaatttccaccacacacatccggcaggacccgtccggagccagatctttcatatggcaaagggtgggaatctcaatatccagtgttttacaggcctccaaaatggtggttcccttttgaacggcaatggcgtgcccgtcgatttccagttcaaccatagaattgtttttctctgtttctgacacagtattttcctccttctccattaactgatacaggcttcgaattcatctctgtagccggctaaggcggaattcacagaaactgataccgattggccaagtccgcaggcggacaaataagtaatatgttccagcattttttcaagcctttcaagatctccgggcctgcccttacggcgctgtaaattctggagcagttccaaaagacgggtggttccaagtctgcagggagtgcatttgccgcaggactcatgaacaaaaaattccattacgcttgtgatatagtccacaacacttacgctgtcatccattaccacaatggcgcctgagcccactgccagcttgttaaaccagaaatctccgtaatcatacaggcggcccttgatctgttcgctggtcccgataggaccggactgcccgccgaaatgacaaaatttaacaggtcttcctgtggaagtgccgcctccgtattcctcgctgtagaggatctcatccaaaggcgtgccaagctgcacctcgtaaatgccccggttcttaatgtgcccggataaacagatgagcttggtgccgcccccgtcctttgtgccaagttgaaaaaatgcttctccccccatattgatcacagcgggaacgcaggcaaaggattccacattatttaccagtgtgggttttaaataaagtcccacatcagccagatggggaggcttcacccttggccttccggttttgccttcaatggaatttaagagcgccgagttttcaccgcagacataagctccgcctccggaaacaatgtgaagattaaagtcaaacccgtcaatcccaataatcttatttcccagatagccggcggcctgggcattgcttaccgcctgatggaatactgcctggatatggcggtattctcctctgatataaatgtaaccgtcattggaaccgaacacatatccagcgatcagcatgccttcaataatgctgaggggatccttctccagcagcagcttatccttaaaggtgccgggttccccttcatccgcattgcagacaacgtatttgggcgtatcggtgctgccatataaatggcgccattttcggcctaacggataggcggctccgccccttccccgaagcaaggcggcatctaattctcctaaaatatcctccctgtccattgtcacggctttttgcagcgctgcaaaaccgccgtgtgttatatattcttctacagaagtgggatcagtcattttccccacccgttttaaaaggactggttcttttattgccattttctttccccctttcagtctatacggctatttttcctctgcgcagatcatcgatcagagaagatattttctcgtcgctgagattaccgaataccgtatccttgatcttaatcaccggaccgatgtcgcaggcgcctacacacggaatatagtggaaggcaaaaagaccgtcatccgtggtctttcccatgggtatgccaagctttttctccagtgataaacacacctcttctgcacgggaaaaatggcagggagaactgttgcagattttaaggacatatttggcctgaggcttatcctttaacatggcataatagctgacaatctcatataccctggtttcggtcatatgcagctcctgagctaccatggccgcagtttctttgtctatatagccttcttccgaagcaaactgaagatcaattaaaatttccaagatgttttcctgctttgccccatcctgccggatgatcctcagcttttcttctctttccctagtatccattgcaatgaccctttctatcttttattttttacttcttattcctttttggcgtcctctttctgcccatacatccaaaagcatggcagggcaaaaaccagtgctccgccgatggcgttaccgacaaagacaactattgtattctgaaagtaactcatccaggtgatggaagactcacctgaaaagattgccgctggaatgacaaaagcatttgccaccacgtgctgaaatcccaaaaccacaaaaatcataatagggaaccacattcccgccatctttgcagcgtaatcctttgcactggtagcaaaccagatggccatacagacaaagatgttgcagccgacagcagaaaccagggccaccataggcgggtcgctgatcttggagttggcaacagccatggtcttggccaaaaaggccccttccgccagccccacaaaatgaccgaaaaagtaggcgacgatcatacttccaaccatatttcctgccataaccaccgcccagttataaaatacgtcccaaaaggaaatctttttctgaaacaggcccacagccattgtcatcatatttccggttgccaactctcctccgaccagcacgatcgccatgagaccaatggggaaaagacagccgccgaggaaggttgcaaagcttccccactgggcgggcatggtaccctgaacgcgtatgcaggctaaaaagccttctgcgataaaggaaccgcctatgatagaaagtaaaaataaccttgtaaaagataacttttttttgatttgagctttgtctcccaaaatatccaaaacttctgccggactaaagaatcccatttccccctccttatgtaacatcatttattttttactgttttctggttccatttttctacatcttccggtgtgttcaaattcactatggcgtttatttccgtatcgctcaagggatacagttccacattcagtgccgggaaagcgctgcgcggctttagttctcctttttcaatttgttttttaaaaacaggaagacaggacttatggtaaaaggcaaacaaaggctctaatttcccttgatgactgcaaaccaaaacctgctcctgatccagcttccggtacatccgccctataagaccaatatccggtaaaggcatatcacaggccataatgaaaacgtattctgtttgaacctgttctaaggcagtgcctatcccgcctatgggacccttttccatataccggtcctctaaaatggaaagtcccgtgaaatccatccggccgtcaaacttggcttttgtattgctgaccagaaccacctgcccaaacaggccttgcagctctctggcagtctgcagcaacaagtactgccggtcatccatcagaaatgctttgtcaaaacccattctcctgcttttgcctccgcataaaataacggccgtcacattctcgatttttttatttacattttcgaaagaaaccaccccctgtttttgtttttcaataaaaacgccggactataattcctgaaaaatttttagacctaaattttttttagaatcaaaaaaacttttttagaatgttttattatattagcaccctgtcaagcccatgtcaatatgtacaaatgagtataacggttccatctatttttgatcacaatacacaaatttagaattttttgtcttttttttgttatgtttttctcaatctttttcttctgttatctaactttttttcaggtaatatatacaattgtttcagtaaaatacaggatgccttgcttttcaatattcttgtaatataaaattagccaatgtattccaaagacttgtcagctgtaacaattaagtccttaaccggggaaacttattttgttaaatatatcacgcatttttgacgactttcagcatttttttacacattgaaaccacgttagaaaagtgttataataaaaaaattttgcacataatcgtacctgttctaccaaaaatgtgcagcagcttaatgggatcggagtaaatatgagtacagaaaacgaaacacttctgcaggccggaaatatggtactgattggagcgacagggagaaacagcggaaaaacaaccctggctcttcagatcatccatgcctttcaggataaaatacctgttgttgcattcaagctgattaccataagggatcatggagacatatgccccagaggaggccatggctgcggaatctgcaaagggctgaaaggctgctttgacataacaccggagaccggcaccgggacaaaagatacgatgctgctgaaaaaggccggggcaaaacaagtctatctcatccgggcttttaaagaaaacttaagagaggcattagaggaagcgctgaaattagtccctgagggcacccttgttctatgtgaatccaacagtgttcgcctggtgtcagaacctgctctctttgttatgatacaaagcagcacttcttccagtataaagcctacggcagaggctgtgatggggtatgcggatgtgatccttcctcaaaatgaagagtcttttgccgactttgttcaggggaattgtatcagaaattaaaattgtatttctcagagttaaactaatgaaatatatttgcttatattttacagtacgataaagggaaatccgtttactgatttcccttagattatatttgcattttttggcttttacattttgttggtattattaaaatctgattttttataaactcaaatctttatttctcttatatggttatattaggcttcgtgttccaccaacacacggttaatatcaagggaagtgcatagctcttacagcctatcgaaccacttctgattcagtgaatgatatttcaacagctctagctttcattacaaatgtcctcttctcgttaagttcaaaattgctggaattgttgttatttaattatcctttaacagttttaattcatcttctggaagtttttctgtgttaataaaaaaaaatgtatttacttactagcaatcaaccacattctatagtaaactaaaattcgttcatagtttctaatatattttcttctataatcttattaatcgttttacatacctgatccttattttcattaataaacatatgagttcccggaaagctataatattgaggtttactagtaaatacacgctcccatgcttgaatatttttattactgacaagtttatcctgttcgccactaaagatatagccactacaattaatttgtatattagaattcttatatcttttaaacaagtcataatcgttttttaaatcttttataatagaggacaaaatggcattatcgttttttataggctctgacaacttaattacatcaattaaatacttatataagttactttctgtataaataagattattgtctgcatattcccacggcaatttacaaccagaaaaaatcataaattgaggcagtgtgttgggataccctaacacttggttcaatgaatgttatatatttgacacctttgctataaagaatgtccatttctttctcaattgtactaacatcactgcaaacatatttacctgaaaaaaccggatatgtacaatatgtacatgcataacaacatcctctggaagttctcatatatacactgggaacaaaatcgtgagatttaaaataatcccaattaatgatttctgaatctaagcagttgttttccttgttggcatatgtaaaagtataatccttttgtatcttataaactatattccctatctcagataaatccgcattcttattcttttttaatgctgcaaccaatttacaaagagtttcctccccctgggattctattatatagcaatcagctcctatataattccaaatgacattgcgcttagactcattgtaggaattatatatatctaggcaccgtggtccaccaactataatttttatatcctcattaacttcccttatataattaattatctcaataatcggagtatcttcaacataaaatgtagttgtaatagcaacacaggtaatttcttttttaagataatttttaaatttatgtttatcattattaaaactattgatatattccacttcaaagccacgcctttttaaaaaagttgtcaagtaaaaaactgctaaactgggggttctaaaaacatccagattccaatgatgacccttctctattttgtttaatataatatttaaaaaatctatgctagtataatatcttccatcaaccagaacagaattcgttagcacttcctcaaatgaacctgtattatttgaaaaaactttctgcctttcggcataaccattaaagtcaacattatttacgccaatcactatgcaatccatgtaattcctccttaaattctttcttaattagcttatctttttatttgagactagcatccctattaaaataattaatgcgccaataacttgagaccaatgcggtatctgtctcaatactactactgacagaattattgtgattaccggaaccatattaatatatattgtagtatttgatatccccacctctgatatgctttgattatagaaaatataagcaagcacggaagaccccaccgccaggaaaataacactgcaaatcgaaactatatttatatcaaaataaaaacccccattatgaataccttcgattaaaacccaaggaattaatccaattactccgtataagaatatataatatgtttctaatgtttccgttatattttcatggtagtctttatataatatgttataaaagctcagactaatagtacttaaaataagtaatagatcaccaatattcaaatctagtttaatcaaattatttatattccctctacatgtaacgattgcaactcctagatatgcaataataataccaataaacttaaatccattaaaacgttcccgtcttaataacatacataataaatatgttaataacggagtggtagtttcaaacaaagctgcattaaatggcgtgctatgttttagtccaatgaagtaaaaaaaatagcatatggtaatacctaatatccctaatataaaatactttatatgcccctttggtgatattgaaatttttttatttggaatccttacaaagaaatataaaaaaagtgtagcaacaccaaatctacacaaagtagcaatgcccggagaggtgttttgtaataacaattgagctgctattgcagctccaccccaaaaaaacactgtaaataacaactttattgatattttatttttattcacaaggcattcctttccatctataattgtatttgattatgtaactgaacactgccttatacaaaaatttaataaatatgaaataatcagtagacatcgcaaatgggtttgtaatgaaatacccatttcaacaggacttcacaagaaagatctttgaactcattgacccaaaaaacagataattttattctaccattgatctccgacgagcggactctgttcaatgcatctgcggccggcagggaccgcagaatgcacacaatcacaagaattaccattataatcgatgatattttttataggcctaaacatagtaatcgttttgtttgcttttttaaatttttctcttaatataaataaaaaaaaatttaaaaacggcgtaacctctgagcctttttaggcatctttggctgatgtgaatacatcatacaagttgtattaatattcaaagttgtgaccattaaagcaaaacacgccagcatatcacccaatttaataaaaagcttcttcatgtctctttccctccttggcatcttatgataacatcatcatattataatttaaaaaaatatttcattctatgtaatgaacggtagatttaaatgttgtgaattgtaattttatcttaataaaaaatgaagaaagctcaattgcaatccgagcttcccgtttttctcttgctttccatggtattatctctggtaacaggatgattttgcgtacaaaaaccggacgtcacttttggcttacaaattttgtactccgaaattcacgtctgctggtatctgtcttttcgttccagccggtggtttcatgttccgattatcttgctactttttcaaaagacctggtgttaaattgatgctgttgacggcaacctcgtagcatcctaatttatcagccaggtcttttccataataaaaacagaatgcttcatacggacttttcccattcagcttttttcttctataggaattgatatgatgtaaaagtcagatcctccttcagtccaccttaaatctccaaacggtcttcataagataaaaacttagccatagtgtctcctttccccacctgttccctccatatcaagttgtaaggtctatgaaatatgctaaacttagtatataatagtttgaaggtcaaaaggtataataacaagaggccttataaaaatcagataataaaagggtaagatctatactattataatccttatccagctaatatcttgtataaagttataacataaaagtcttacaaatacgttttaattccaaaccttataataacaagtattaaacttcatcagtttcataacagaacaaaagagagaaaacagaggtataacatgataaaaattgcaatttgtgacgacgaccggtttatttgttcacaagtggaagatattattataaattattcaaaactaaaatgtataaagattaatacagatgttttttattcaggagaaagcattttaaattatcttaatcaaggtaattcttttgatttaatatatcttgatatagaattaggaaaaacaaatgggatcgaagtgggccaacagttacgaaaaattatgaaaaattatacaactgaaatcgtatatatttcaggaaaagaccaatattataagcagctttttgatgttcaaccgttaaattttattgaaaagcctattaggcaccattttgtaattagtgccctggaattgacacaagaaagaatgcaaaagtctgccggattatttcaatatcaaaagggttacgagatttataaaacaaaaataagtgatattctatattttgaaagtctgaaccgaaaagtgaaaattgtgacgacaaaacaagaagatttattttatgggaacctggataacgtttcaatttatatctccagctatccgtttttaaaaatacatcgttcttatctgattaattataatcatgcttccgtattaaaatattcggaggtagttatgtccaacggtacggtgcttccaataagcagaaatagaaggcaagaaatcagaaatttgcaaataaatggagaataaggcaaaacaaatgagtattgacaaatatgcaattatatattggctcagcgatctgttcatggcatatgttatctataaatacgttcacattttttattctgaatttaaatttagcaggaatatagagtggtttgtttacataggatactttcttttaaatgcttgcatttatatgtctataaaaaagcctctgatagtaatgacttccacgattttattactcttgggattaacctgcctctatcgtggaagtttaaaaaaggccttgttatcagcattcataatttttctttctctaatgtgcatagaaacgactatcgtcttcttgacagattttcccggggcggacctttttgcctcatttcagcataaatcggaatttggcatcatcagcatacggattgtgtcttacgctttcgtactcctggtgcaaggctttatgcacgtaaaaaacgagtacccgctccctttcatttattggataagcttaattttagttccttttggaacaattattttacttcttattattttctcaggaaattcagtaccatccatttatatcaccgcaagcattggaattgtttttatcatcaatattgtaaccttttacctgtacgactgtatttccaattttatgcttgaacaaatgaataagcggctggtggaagaacaaaacaaatattatgaacaccagattgaattgatgaaatcatcactggaaaatataaagatctttcgccatgatttaaaaaataaactgtcaccgatctatggcttagcgatctcaggaaaaaacgaagaattaattgaacgcatttctgaattaaccgaaacttgcagcggaaattacgggcagattatatccggaaacagcgacttagacagtatcataaatttcaagttacaacatgcggaaaaagaaaaaattaaagtgtccacaaaaatcctggtacctgccaaactttccatttcctcatttgatcttgccgtaattctggggaacttaatcgacaattccatggaagctgtgtcaacaatagaatcagatcggtggatcaacattgacatgatatatacaaagggccgcttaattcttaaaatcagcaactcatttgatggcattttgaaaaagagcgatgacttttttatttcacgcaaaagtgatcaggcgaatcacggtctcggaataaaaagtgttaaagcagcaatacaaaaatatgatggagctatgcagataaccaatacggacaaaacttttactgttaaaatccttatgtacgtacaaccctagaggttatattttatgaccggaaaagaggcgcgaatggaacaatttgcaaataaactgactgaaaaactggtgttacatcaaattattaaagacgaggataaagatttatattcttatggtatctggcaaggtgcaatcttattatttaattttgcaactgtcatagcaataagctgtttgtttcaaatgctctggcagggaattgtctttacaatagcatatggttttctgcggtcctatgccggaggataccatgcccgtactcagacaggatgttatctattctctgttgccctcatatgtgttgttctcagccttataaagttcgttgagtggaacaatatcagcattgtcatcagcgtcattctatcaggtatcctcatcttagcgctggccccgctggaagacgaaaacaaacggctggatgtaaaagaacaatatatttttaaaaaacgttcaaatattgttttactgattttggcagtcataaccttacttgcaaatttcattggacaagttcctgtttctatctgcattaccatgtcaatatgtacttctgcatttatgcttatattgggaaaaataaaatatatatctaaataacttaagtaagcttttcctcctcttacaacccagaaaaggggaaatcatcagtctgatttcccctttcccttattgtgattcccccatggtctccggaaccacttcccggctggtttccaaaagtgaatcagaagttttgctgccctcccagtaccggtatccaaacacacctcctgcagtcagtccggcgatcagaaacagggcaaggataaaccgcaggatccccataaggatctcccgtctgcggtttcttctgcgcctgcggctgcgccctttcgttctatcatattcttccggcttcatctgtggtttccccatccttcccctttggttaatcagaaaaatactttttgtagatttcaaaaaagttcgtggtagttgtcctgtcatccttggagaattttacatccttccagatttcactgctgaaggtgaccggattttcattcttaaactgggaatagatctgatcaaagacttccttcttccgtttccggtataaccctgatttcctctcctgggtggcatcttcgtcataatcgttcacacaccgtatgatatagtatttgcccttattctccaccacctggctgatctgacctgcggaaagagaaaaggcggcgtcctcgtaggggcctggattctcccctcttcccacctggcgttcaatggttccatcctccgaatattccctggcaagtgcggaaaagtcagccccctcggcccctgcctttaaaagcacatcaccggcctcggttccatcggacaaaacgatctgctccacaacgatcaccttggcttcgctgtcactgatctctaaattcatgtcctttgtcagttcatcaaccaccttgttggataagtaatattcctcatacatggtcctcacatcctcttccgtggctcccatgtaagagatatcatcagctgtcagggaatcgaaatactcctccgatgccttacgcacctcttccttttccgcgctggttaaggtgactcccttattccgggccagaagattcatcattttcatttcctggagaaattcctttacctgatccaccagataggtttcaaaggtctggccgtcgggtaaatccactccccagatctggctggtatagatccgctgatactggttcctttctgtagccaggatcatcatggactgcggcagggtatacgcctttgtggttgacgtttcagaaacaaggggatatcagccttgcagccggacagcagggcaattgccgctgcagcagccagaagaacccttcttgcactcttaagttgacctttcatgagcatccctctctttatgctgcttaaagcagcagcttcagtattttcaatactccgtcatttacattggtgtccgcctgaaatctggccacagcctttacttcttccctggcatttcctacggcaaagctgtaatacgcctgttttagcatctcaacatcatttaactgatcaccaaaggccatggtctcctccggtttgatccccaggctgtcctgaagaagcttcacagcctggcctttattgattcccggcctcatgcagtccatccacatgtctcctgctatggttattttaaggcggtccgcatacttttccctcaggattctggtatgagcctccacatctgttttacggtatacggaaaccttgataaattcagagtccaccttggtcaactcctccacctgcttcacatggaaccggtagccgtttacaatccagtccagaaattcctcatcttttgactccgtataaatcatatcaggtccgcagatcatcacttcaagcccatccatattccttacatcttccaccatatccatgaccgtcttacgctcaatggtattgatgaacaggcttcttccatggcagcccacataagcgccgttatccgaaagatagaacaccttttccctgatggggccaaatatggattctatgctgagccactggcgtccgctggccgcggcaaactgtattcctttcgcccgcagctttaaaatcacgtcataaagctcaggattcagctcgtggcttccatccgtcaccagagtcccgtcaatatctgatgcaatcagtttaatcattccttttcctcctgtttaaacatctcctttatctcctggtacacacgtcctacaggcaatcctactacattattataatcgccgtcaatccctttaataaaagctgcaaactttccctgtattccataggctcccgccttgtccatgggctccgctccgtctgaataggctttgatttcctcatcagacattggatacagacggacatctgttttttccacaaatgtttttaccctattgcccttctgcccacaatagaccagggtaacccctgtgtatacctgatgcgtccttccctctatcatggagatcatccggtaagcctcctggtggctggccggctttcccaggatttcaccgcctgctgcaaccacagtgtccgcaccgatgacacaagtaccaggcttctgccgggcggcaacgtcttctgccttttgccgggacagctccatcaccgcttcctctggcacatctgtggtaatcatctcatctatagtgctgggtacgatctccggcgttatcccgatctgagccaaaagctccttccttcttggtgaggccgaagccagcaccagcctttttatcctgtccatctaaaacctccaagtcacttctacaaacgttatggtatcatgtgccaaagagcacatgatcaacaatcaaccttcgccttgagagcaagcgctcaggctcattgctttcatggcataaaatagcaaataagcgggacccatatcgaatcccgccaatcatcaatatactttcaaacgcccaatcatggacgtatcatcgtcttcacagtcagcccgaagctgcatcctcatggtgtatatgaaatcagccaaatagaaaatcaaaaggctcattgccaccaaccgttcaaaattccccggaaccattcctgccatctgattgacaaacccattgaggaagcggaaataaaaaattcccagaaatccccacgcaatactgctttccagacagatgattcctttgtaattaaacaacttctgactgtaatcccaccagaatgaaccgaacagctttatcatcatatgagctgtgacaagctccataaaggtagccataaccattgcggcgaaataaagatgaaccggattgcctgcaagaggcttgagcaggatcatcgctcccatggagccaaatccataaataatacagaatggtccgtgtccgaatccgcgatttagaacaggccttttattctcataactaagtacggcacattcaagaaggtatcccaaaaggctgaataggaaaaaacagtttatcctatgataaattgacatatccattttacctccaattttaacaattttttaacttgttaaagtataatatggatatcttaagaaatcaaggactattttcttacgattcccagaaaactttcttctttctttccgtggatgaaacgaattaaaatcaggctcccctggccttgccaactgtcccagcggtcaaatacccggatgctttctgctgtattcaactaataatactgtgaaataaaaaatgccagcaggattcctaaaatcgctcctgcagccacctggagaggggtatgtcccacatattccttaagcttttcctgtaatatttctcctttaagctcaaatgggttttccagaagaatgctgtttaacagcttggcctgctttcctgtttccctgcgcactcccatggcatcgtacataactatcatggaaaggacaaaacagaccgcaaactcaaaagaaccgacgccatagcggtagatggcggcggtcgataatgcacataccgttgaggaatgggagctgggcattcccccagatcccacaagcctctccggattaaagtttttgttaagggccagatcgatgatcgtctttaaaacctgtgctaccagccagccggcaactgcagtgatcaggacctgattcccaagtaaatcttcccaaaatgtcatggtttcctccgtcttatgcagcgcttttctttccaaaaccgaataagatccaacgcttgatcctggacactgtttcaatcagaccgcaaaatttatctgaataaatgatcaccattccctcccggctttttggaggaatgggggtcagcggccacatgtgacgcaaaatcatatctttctctttttctgttaattcaaaatgttttactgcattgttcaatgcagtccgggggtgagtaaaaccatggaagtgctccccggtttcctttgcgtgggtatgccagtcgtacaaaaacaagtcatgaagaaggccggctctggcaacctctgcataatcccagccccgcttcctgcaaatgcagtagcccatataagacactttaatgcaatgggccttacaggtagtgtcgccatgctgcatataatcatccatggactgaaacaccggactgtctataatatcctttacgcagtccatataatcgggatcctcgcggtaatcttcccgtaccacccaggaagaatcttctgcccatcggatagcttcttctctttcttcccgggtaaaatgcatattttccatcttaattcaatcgcttctttcctgatcaatgaatggcttaatagccaatcagccaatcatagagttcctgatacttcatggctgaagttttccatgagtaatcctttgtcatggcgcggtcaatgattttgttccactctcgttttttatcgtaatatacgattttagcgtaccggatgatacccagcatttcatgagcgttgtaattggcgaaggagaagccggttccccggttctcaaactcattataaggctctaccgtatcctttaacccgccggtctccctcacaatggggacagtgccgtaacggagagccattagctgacttaagccgcatggttcaaacagagagggcataagaaaggcatcacaggctgcataaatcttgtgggacattgcctctgaataatagatattagcagaaaccttatcctggtatttccatgcataatggcgaaacatattctcataccgctcttccccggttccgagaactaccaactggatgtcatcctgacacaactcatcgatcacgcactggatcagatccagtcccttctggtctgtcagtctggaaacaatgccaatcataaacttcttatcatcctgattcagccccagctcctgctgcaaagcccgtttattcttcaccttctccttacggaaattctttaagttataattcttttcaatatacggatcagtttccggatcgaattcctcgtaatcaatgccgttaacaattcccctgaggctgcctgcacgtgcacgcataaggccgtcaaggccttccccgtaaaacggcatcttgatttcttccgcatacgtatcgctgaccgtagtaatggcatcggcgtaaacaatgccgccctttaacagattgccatccttataagcttccagcttatccggcgtaaaatagtaatccggcaggcaggtaaacttctgtatggtcttaacatcccatacgccctgaaacttcaaattgtgaatcgtaatcacggatttcatgccctgaaaaaattctccttcatgaaaacggtcctttaataaaacaggaacaagggctgtctgccagtcatgacagtgtatcacatccggctgaaatccgatcacagggagtgctgacaaggctgctctggagaaaaagcaaaacttttccaggtcactgtaccagtcaccataaggcttggaaccatcataatatccttcgttatcgataaagtaaaaggtaatcccctcttgaacatactgaagaattcctacatacctgctctgccccagataatccatataaaaatgatcgacataggtcatctggtctcttaaatcttccttgatgcacaggtatttgggaatcatgactcttacatcaaaaaactctttatcaaagcattttggaagggatcccacaacatctgcaagccctcctgttttaatgaaaggtactgcctctgatgcaacgaataatatcttcttcatccaaaaacctcccttatccttttcccctgggggcattgtcgattttcctctagtatactgcattttaaggaaataaggaagtattaaattttacaaattaagaaagttttttataatccagccttattttatcggcaatcaaagctatgaattctgaattcgtaggcttgcctttgcctgtgctcaccgtatacccaaacaattcattaatagtatccatctttccccggctccaggccacttcaatggcatggcggatggcgcgttccactctgctgggagttgtctgatgtttctttgcaatggaagggtaaagtatctttgtgacagaggtgagcatttcctggtcctgcacggaaatgacaatggcatccctcaaatactgatatcccttaatatgcgccggaattcctatttcatgaagcatttgagtgacatcattttccaggttctgttccatgtactctgttttattgacataaggttttacctttttcatcccctgaaggctgggagccttcgacttcctctgtcctactcttcgtaccttgtcgacgataatatccttattaaacggcttcattatgtagtaatttgctcccattcggaacgcatcttctgtaatattctcacttcctgccgctgtgaccatgataaatgacggaatctttgtaacggcgccgtttccgcgtacacgttccattaccgttattccgtccattctcggcataatcacatccaataagacaacatccggatttgttttgaggatcatgttataagcgtcttcgccattatccgctcttccaacgacgtgaaagtcctcctctccctccagtatatcgttcagcagatttaatgtctgcaggttatcatccgcaatcgcaatactgatttctgacatattgatactctccttctgattcttcaaaatagattaaaactagtgtaaagccattatagtcttgccctagctcatgtcgcaacgggattctatcgcattattcgacaaaaagaactgcttttaatttgatttccggaatatttttttctcaaaatgcgccagaggtcgaaaaggcctaccccggtacgggtccctgccggacctcttattttttgccggtgttgaaaattgaaactccttgtcggcaaaaaaatcccgaaatcttccatcccacgatttctatattaacacattataattactatgaaaagcattaattataaaatatggcattttttgtaactttaattactacatttcgacgattaaacgaaatatttctgtatatttcttgtataaaacaccgaaaatctcagttctttctcgaaaatctgccgtaacaattatttttaaactaaaatgtgaaaaagaaaagaacggcgctgcaaatatttacgctccggttcttttctttccttgttgtcagactcagtgattgatcatgttttctatgaagatcccatatcctcttgttgagtcctggatgaacacatgggtaacggctccgatcagcttgccatcctgaataatggggcttcctgacatgccttgaacaattcctccggtcagggccagaagatccgggtcagtgaccttgatcaccattcccttgcttttatgagttgtggaataatccactcgctgtatctcaatctcataatcccggaccttaccggatacatcgcttctgatgtgggccgttcccttcttcacatcctgccggtagccgatgggaatggcatcctgcgccagactctgcttaaatctgtcatttacacttccaaatattccttcttccgtattggcgctgatggtaccaagagtagaacctggtccgtagtagatgatgccgctcatcactcccggctttccaaaggttcccttttcaattccaaggatcgctgtttcatatagtgctccatctgtgatctgcaccacattaccggtatcgctgtcgctgattccatgacccaatgcgccgaactgaccgttcatatccacataggtcatggtgccgattccctgagtatcatcccgcacccagacacccagcttataggttccgtcttccgcttccgtgggattcatttttacatcaatggtttccccgttccgtctgatttttaacactgcctcggtagggccgattttgctcagttcactcatcagcgcttccttgtcctttaaaggtgttccattgatggcctcgatgtaatctccggactgaagaatcccgaaggccggttccacaaccattccgtctttttttgttacatctccggtaccgatcaccatgataccatctgattttaagtagatcccaatgggagtgccgcatggaatggcatatttggtatctactacattcacctgtatatcttttaattgaatccatccaaatagcttcagccccagcttgtagcttccctgattttccgaatatacggaaaatggctggtttacctgaagatggatctgatcggaagggatatttgatccgttatttaataccacttcctcgctgtcggaatacagcgtcacatcaaaaggcatggagaaatgaaactgttcttcttcctgtgcaacaatattcagtttgtcaggaattacccgcttcatatagaaccaggaaaatccgatgcaaaagatcaagctgatccaaaatgctcttataataatcctatgaattttattttttcccatctcacatacctccttaggtgaatgaaaggagacaatttttttgctcctctcttagtatgtgagaaattaattaaatcacactgtcatattttagttgtaactattttctttcggtggcagctattgcaacagaatgaaaatctttttacgcattttgcttgattcggcagggatatttttttgtatttcagatatggctttttcagttataaagacataccttggaaacacatgataatccgtccgtaggatacaaactaaaattaattctcacaaaaaggatgatgcaccatattcccgcattttattaattgcatttcctttttgtccacaaaagtttaataaaataggatgaaactccttctaaacagtcggaacctattgacgtattttccaggttctatatacttgtcaggctttatgagactcaggctttggataattccggcgacagcctgcagctgcccggctgaatattgtctggttaaattgtccaggtgaacagtttctttcatgagaatgtttcgcattatgacttacatatttttccagggtgccttacttttctttgaaaaattttcagttactctatgttggtataaagcctttttctgtgataaaacaatctttattctatcccttttggaatcatcattttatttataattataatctccaatttttaattttttattgataaaataggtgaactgagatttataaatgactacaaatccctcaaaagggcggtctaaatcagaggtttttttacactttcttatatttctgcataactcgttacagtgcagttttcagaggtccggcatcacaaatattgctacaatatcagttaaaatgttctattttattcgtttcattttctttccggtatgatatattttgaagagcactcataaaaaataagtatcctattttgtaaatgtggtggctggagtcagccctgacccctgctgattttcagtaatcattattcatgactgtgacataaaatgaaattgtcaagcggacttgaggagtatattcaggcagtaaatttgcaaaagcccattttggaaacattatccgataagttcttttcaaaccttccgcaaggtatcactcattcagactttgctgctgataatatattatttaacggtgatgacgtatcggcaattattgattttgatacgaatagatatgggtatgtctggagagatattggacgggctttgatttcatttacattaaataaaaataccataagcaaaaataaaataatttcgtttatagaaggctactctcagcacatgcctcttgatttttctgacgcacttaattccttacgcctaacgtggtgccttgaagtaacatggtggatccaactccattgcttccaggaaaaacatgatattcattgccttatgcaccaaacaatattataattgtatggtataaggaggtcactttatgccatttaactcttttgaaaactaccccatgtcatggaaacctgttatagacaaaagccaaaaatccctctatttgcagctagcccgtcaattagagcaagatattataaaaagccggttattgccgggaacaaaactgcctccgcaaagagagctggctgattatcttgacatcaatgtgagcactgtttcaaaagcctttcgtgtttgtgaattaaaggggctcttgtcctccacaatcgggcggggaacctttgtgtcatatgacgctctggctaacaaccgtttattaagcgagggaaataccgggaagttaattgaaatgggggccacggtccctgaaaaatcttcaaatgaattattattggaattattaaagacaatgctcagcgaacacgacgccggtaaatggttcagctacaaccggcctgctgatacaatatggcaaaaagatgctgccgtacggttcctttcccgctgcggcctagcagtttcccatgaaaacattctattttcaaatggtggacagaatgggcttacagccatactagccggtttatttcattatggagacaggataggcgtcgacgctcacacctattcaggcattaagaccagcgctgccgcattgggaatacagctgattcccataaagcagcacaacgatgaaatggatctggattcacttattaatgcctgcaaaaattccggaatgaaaggaatctatgttataccggcacatcacaaccctactgcaaaaaccatgtcattggagaaaagaaaggacattgcccgaatagcaaatgaatatgacttgattgtcattgaggatggcacttatcagtttatggctgaaaccattactccagtcgcatcccttgttccccataggaccatttatgtagccagcctttcaaaatcagttgctccggggcttcgtctggcatatattgcttcaccgcctctgtaccgctcagaaatctcagaggcactttatacgttgaacgtctctgtatctcctttgatgacagagctgtcttcaagagtcatcgtatctggtctgttagatgatataattcaaagacacagaacaaatacaaaagaacgcaacctgattgtaaacagatatttgaatcagctggattgtaaaggagatctctgctgtatatttcgatggttaaaacttcctgggaatatttccggcttggaatttgaaagaaatgcgcgtttagcaggcgtacaagtatacgcagcccagcgatttgccgtaggaaccacggctccggaacatgcggtgcgcctggcagtttgtgcgcctgaaacaatcacggagcttgaaacaggcctgaggatcctgaaagaattactggagcaataattgtacgccatacaattattatattgtatggctcaccgatggacgatataataattgtagaatcagagtaactattacgaaaaggaaaagactttgtgaaatcactgaattatgccataaaacaaataatcccgttggttttttcttatgtatttgtgggcctggcaagcggtattctgctgaataaagcagggtattcacctatatgggcatttttatccgccttactgatctatgcaggttctatgcagattgttatggtaacacttatgacctccggtgctccgttatacatgatagctcttatgacactgttcattaatgccaggcacatcttttacggcataagttttattgatgaattccgcaacataggaaaacaaaggagatcatactggaaatatccttacatggctttgacaatgacagatgaaacatactctgtcctatgtgctttaaaatgtccaattgggctggataaacaaaaggtccaattctatatcttattcctttgccacatcctttggattatcagctgttcatcaggtgcagtgattggaaatgtactgccaattgacatggcaggtattgaattttccgcaacagcattttttacagcagtcgttgttaatcaatggagagaatttgaatctcatattccggctgtcatcggttttataagcgcagtattattttactttttaacagggcctgatcatttcatccttccggccctgtctgtaagcatgattttattagttatccttaaaaaccatattcataaagggactctggagggcagaaatgagtaagaatctgatggccgcagcaaccattggcattgttgcaatgataacatggatctcgcgaggtctgccttatcttctgtttatgaaaaaacgtcctccgcaaataatatcatatctcggtaccgttcttcctgcttccattatgctgattctggtcatctattgccttaggaacactcaatttacggtatatccccatggcgccccggagattattccagtggtgcttgttatcgtcatgcaattttggcacaaaaatacgcttatcagtatcttttcaggaaccctttgctatatggttctgattcgtaccgtgtttcccatataaggaatgttaaaccggccaccaaaaccggaaccggaaaatcagcacagaaaagggagaaatcattccgctgacgcatacaagggatttgctgtccgtattttatcagcgaattcctttttcaattccttaaaagcatcctttacttctttcggcatatccacatgagcaatatagccttttcccttcggcccatatccgttcccatcatctgataatcggggaatctcgcccattaacagcgttatatatctgtccatgtcccacattccccatatttctttttcaaaaacaagctttgaatcctttacaatcacatgggcacagtagacggcataattaatgatggtcacatcgtcagaaacatacttccggagtcctgcctccattcgatgctgcattgttgcgtcctgtgcaagaataatacttttaaaaggaatattatgttccttcagcaattccagaagatatgttatgttgtttccgcagtttgtagaattgcattccagaatatctgcttttaatccataccggtgctcaatatatgcatcaaatatttccgcttccggcaaaccggccgtttctatatccgggaactccttatgcattttcaggcgcagggtttctgttgtgtgacctgctccgcctgcaattacatatttttttgctatccctgcctgcattgcatgtgccaggacatccccgccgcacataatgctgccgccgaaaaggaccattacatctgcctgttgtattccatacttttttctcagcccatcacaagtcaatgcaggaatatctctcttcccgcaaaaactgcctaacatgtttatgcattcagcaatattatccttcaatgatttttcctttcaacgccaattcatggtgatacaactcaagcgccaagagatactaaaaaagaaaagcaaaagcgacggacaaaaagatggccggaagcaaatttgccacctttatcatcttcccccagaccagattcacgcctacacaaaaaatcataaccgaaccggttaaggacagatttgacaatgcctgctccgtcataaggggttcaataagtcttgccagaagcgttatggttccctgaaatatggcaaccggaatcgctgagaaaatacacccttttcccagagacgcggtcatgaccagaatgataatcaaatccaggagcgctttggctgcaagaaccgtataatctccagagattccatccttgatggaacctaccactgccatggcgccgatgcagaccgttaaggaggctgttacaaatccgtctacaaatcttgtatcaccgctgctgttggtttttatcttaagccattccccaaaccgttccatggctgattcaatgtccagccactccccaagcagggacccaatgaaaaaagacaggatcagcatcatcgttcctctgctggtaagctctccctgccggatgaccagcatttctcccataacgccctcaataccaagaaacaccacgcagataccggccgcattcatcagcgtgcgctggtaccgctcctccatcctctttccaaagagaagacctcccaagcctcctgccgtaattcctaccacatttatcagcgttcctaatccaatcatgctttcatactcccggttttcattatcatttgcaaaaattcacagcttatctgctttcttttgcaagccgcttcatttcccttgcattggctctcacagcctcggtgatctccgcaccgcctaaaagccttgccagctcctctaccacctcttctccgcccaggcggtgtatggaggtggctgtccggccttcttccaccgccttagcgatctcgtaatggcagtcagccatggcggcgatctgaggcaggtgggtgatgcagatcacctgatggttcccggcaatgtaagccagcttttccgacaccttctgggccgtgcgcccgctgatgccggtgtcgatctcatcaaaaatcaaagtcggaatgtcatccgtatctgccagcacagttttaattgccagcatgatcctggacagctcgccgccggaagctaccattcccaaaggctttaaaggctcaccgggattcgtggaaatcaaaaattcggcctcgtcaaagccgttagccgtataatgtccaaggcgtgaaaattccatggaaaattccacatcaatgaaatttaagtcctttaatccttctcttatcttttttgtcagctccttagccgtatgctttctcatttcagataattgcccggaaagatgttccagccggtccgataccctttgaagctcttctgccgttctctttttagccccgtcataatcttccaactcgtccaggcgtttctgcttttcttccagatttataaaaatctgatccagacttcccccgtattttgcttccagattgtgaatgacatcaagccgctcctctatctgtccgtattcctcttcatcaaaagacatgtcatccatataagaggttatttcccggttgatatcacttaagatggaatccgcatcaaaaagctggtcccttatggcagaaagtctttcatcgtaggaagcaactgactccacttcttttaaagcacggctgataaagtccgaatccacggcggaataagcaatggaaaggctttcggttattttttttgcgttcacaaacagccggtacctggaagacagttcttccttttctccttcttttagacgggcattctcgatctcttctatctcgtaacggataaaatccatttccctgagcctgacctcttcgtctagctggaaggcggaaaggcggtctttcagccggacatattccttatatgtatctgcaatattttcttttagctcatgggactttttctcctggtagcggtccagaatctcaagatgtttggatttgtagagtaaagactgatgttcatgctgtccatgaatatcgatgagaaggcccgttatatcccgcagcttccctgcggtcacggtttcgtcattgattttgctcaagcttctggagggcatgatcttttttgaaataatgaccgtaccatctccgtcaggataaacgtccagctcttttaacaggcggactttctctgtgtccctgaccgtaaagatcagttcaatataggcgtattctgtgccctttctaataatatcctttggcgtcttgccccaagagcaatggtaacggagccgataataatggatttaccggctccggtttcgccggtgaggacattaaaaccctgtccaaactccacatcggctttttcgatcagggctaggttctttacgtgtaattctgaaagcatggcggcctcctttatcccgtaatgagttttttaagcttgtccatcatgagtatggtatcatcagagctccgaatggcgcacatgatggtgtcatctcctgcaatacagcccaccatttcactgaaatgaagggcgtctaacgcagcagccaccgccatagccatgccggatacggtctttatgaccagaatgttctgtgccatgtccatggataaatagccatcccgcaggatccggatgtacttatcactgaaggaactctggttttgaagcaccacataccgctgctttcctgactcagactgaacctttgtcagcttcagctccctgatatctctggaaaccgttgcctgggtgactgcaaagcctgcctgattcaaataatccgccagctcctcctgagtttcgatctcgtattttccgatgagttccacaattttgctgtgtcgttccagtttcatagtgcccctccctatataccagccattttgttgcgcaggttatctaaaaatgatatgtttttcagctttatcagaatggtcttaacctctgaccggcgtatctctatgcaatcccccggataaagctctgtagcggtgtctccgtcaaatactgcagcctgacatacgcccttttttcccgtcatctcgatctggatccagtcatcggcagaaaggacgatgctccttgccccaagggcatgagagcagataggggtcagaaccaccattttggaatccggaacaatgatcggccctcctgcggaaagattgtaggcagtggaaccggtaggcgttgctgctataagcccatccgcccggtattcatttaagaattcctggttcaaataaaccttaaactgcagcatctttaaattatcgcttctggctaccacgatctcatttaaagcgatatcctgacatacaggctctccttttcggtaaatacagccgtccagcatcatccgttcttccagcttatagtcattggcaagaagagcggaaagggcgtcattgatttcctctgtgcgggatacctgggtcagatacccaagggtcccccggttgatcccgatcatagggatattccggcctgccagatctctggcagcctgtataagggtcccatcgccgcctaaggtgataaggcactccgtttcttccggcaccatggcagcatcagtataatggctcttctgatgccgcttatcctggccttctcccccgatcaggcagacggctccatgatctgtaagataatcgcgaatggctcttgcagtctctctggccccctctttatcagggttcatgatcacataaaaatacttcataataaactccttacctgcaagaataatccgggtccccttcggtgccttctcgtggcagaccgttctcgcgtcctgttaagtctgcatgagcttcttttacgatcttttccggatccacctggctctccggttgttcttcgcctggccggtggttttttaagtgaagaagatactcaatatttccttccggtcccttaattggggaatattccagatgaagcacttcaaacccaatgctttccgcgtgggaaataaccattcggatcacttccaaatggacggacctttcccttaccacgcccttttttcccaccttttcccgaccggcttcaaactgaggcttgatcaggcagacaatctccccttcatccgtaagaagggcttttacagggcccaatacctttgtcagggaaataaaggaaacatcgatggaggaaaattcaatagggtcggccagattctccggagtaacgtaacggatattggttttttccatacacaccacacgctcatcgttccgaagcttccatgcaagctggccgtggcccacatccaccgcataaacctttacggccccgttttgaagcatacagtccgtaaaaccgcctgtggaggagcctacatccatgcataccttgccttccagggtcacgccgaaatgggtcatggccttttcaagcttcaagccgccccggctcacgtaccgcagggtgcttccccttacctcaataattgaattttcatcaaatgtggtgccggctttgtcttccttctccccgcctacatagacgatcccggacatgatgattgctttggccttttccctggactcagccagtccctgctttactaaaagcacatccaaccgttctttcattccttttcatttcctctgttttatcttaataatttgtccttttccattccgcgttctgacgttctgtgtccagatattcctttttaagcctccatatgatggaatcactgtcaatgcccagtcccttgcgaagaagggacacgttgccatgctccacataggaatccggcaaggcgatgttcatgacctttacatatggataatgctcatgaatatagctggcaaccgcagggcaataacctccctgaagtacattttcttccatgatcaccaaaagccagtgattctttgccagccggtccaccagttctttgtcaaaaggcttcacgaaccgtccgttagccagagtgcagttccagccttccgccttcagcttttgcctcacatgctctcccgtgctcaccatgcttcccactgccagaagagcgatatcactttcctcataaatcatctctcccttgccgtattcaatgggggcgcggaaattctttaaaccctggtatgcctctcctcttggatagcgcaccgcaaaagggccattataggaaagagcaaattccattccatccatgagctcccataaatttttcggtgcaaacacgctcatattggggatggcagtcaaataggacaaatcaaaaatcccctgatgagtctccccgtcgctgcctacaagtcccgcacggtctatagcaaagacaaccggcaggttctggatgcatacatcatgaagaatctggtcaaagccacgctgtaaaaatgatgaataaacggccacaatcggctttaagccgccggccgccattccggccgccgaggtcaccgcatgttcctccgcaattcccacgtcaaaaaaacggcccggatatagacgggaaaaccgctttaaacctgttccatccggcatggccgccgttaccgccacgattcttttatcttgttcagccagacgacagacggttttggaaaacacatccgtatagctgggatttttcttcttctttttcgattctccggtgataatattgaaaggctccactccatggaatttggaaggattcctctccgccagggcatatcccttgcctttctgggtgatcacatggaccagaaccgtatgcggaagctttttcgcctcccttaaggtcctggaaagagcctttacattatggccatccacaggtccaagataggtaattcccatgttttcaaacagcatccctggtatgagaagctgcttgatgccgtcctttgtcctgctgatcttatcgatgatctgctctccgatgaccgggatcctggacagcacattggtcacgtgcttctttaaatccagatacccctctccggtacggatgctgtttaaatacgtagacatgcctcccacattttcggagatggacatgttattatcgtttaggataatgatgaaatttttctttatcctggccgcattgtttaaagcttcataagccattccgcctgttaaggctccgtctccgatgacggataccacgaaatgattctcacccagcacatctcttgcctgggccagtcccagcccggcggaaatagaggtagagctgtgaccggtatcaaaggcatcacaagggctttcttttctctttggaaagccgcttatgccgccgtactgccgcagatcatcaaactctcctcttctgccgcttaatattttatgggtataggactgatgtcctacgtcccagatgactttatcctttggaaggtcaaaagccagatatatggccatggtcagttccaccactcccagattggaagccagatgaccgcctgtgacgcttattttctctaccaaaaaatcacgaatttcctggcttaaaatatcaagctcctgctttgtcagctttttgatatcctcaggcccatttattaattccagtatcatatttttatcagatcctctatttgcgttaggtttggccatacagccggacttccgcttacttttcccggttcaccagcatccgtatgagtgcttccagaaattcattctgtccgggaagctcatggaggcaggaaatcgcctcttctgaaatcatctccacatcctgcttcgccttttttattccctccagggttacataggtggttttgtggttcttttcatcgctgagtacaggctttccaagaacctcctcactgctgattaagtccaggatatcatcctggatctgaaacgccattccgaggcaggaagccatgttctccaccagcttcagctgtgcttcatccgctcctccaagaacggctccgatcatcatggaagcctctataagcgctcctgtcttcagccggtaaatgaaattcagcttttccttgggaatgggttttcctgccagctccacatcaacggtctgaccgcctatcattccatagattcctgttttctccgctaagatccccatgcatctggcaaccagatccggcctgccgctcatggaaagagcttttgcagccgtctccatggaataaatcagcaggccgtctcctgccagcactgccatgtcatagccgaatttcacccatgccgtaggcaagccccggcgcagggtatcattatccatacagggaaggtcatcgtggatcagggaggaggtgtgaatcatctcaatcgccgccataaacggctcgatctcttttcccctgccgccgaataatcggtaggtctcctccatcagcatgggacgaagcctttttcctccggccctgacgctgtaatccatcgccgccagcaccgtactctgatagccctccacaggaggaaggtatgtttccacaatgtgccccacttcttctgtgcgggcagaaaacacttcattaaagttcatgttcctcaccattttcctctaacacgataatcttcttttcaaccttatctattttttcattgcagaactttacaagcttcatgcctgtctcataatactggaaggattcctccagagagctttctccgctttccagtttcttaatgagctcttccagctcgctgaatgtctcttcaatggtcttttctttttttgccgccataagtccggttctccttattcagtttccttttcctgcccgtcttccaggggaatacagtcatacctggaagctgcttccttccggctttctgataagccggattcctccggggcaatgcgggaaaccactgcctccatgctgccatccttaagccgtactcctatcctgtctccggcctttacctggttcacggaattgatccgcttattttttccgtcggtcacaaagccgtacccgccgccaattctttttaaaggggatccagcttccagacggctgatgagaagctccagcctgtgcctgtcccgcaccgtctgcttttctatgagctgctgcatgcggagccttccttcttctgcccttgtccggcctgcagccgtctttacaagaataaggtttttcagcctgtcctctatgtccgcaagcctttgacggctttcatggatccggcgctttgggtcgtatattttcagttttaaggcgtattggtttccctgaaaacgatatcgttccagttttctttccatggtccttaaaagggtattgccatacagccccacctgttcttcgaacaggcggtaatcaaatacagccagctcggccgctgccgagggggttggcgcacgcatgtccgccacataatcggtaatagtcacatcggtttcatggcccacggcagaaatcaccggagtggtgcaatgaaagacagccctggccacaacttcttcattaaatgcccacaaatcctcaatggaaccgccgccccgccccacgatcaggacatcaaggcccatctggtccagggtttcgattccctttacaatactttcctttgcgttctccccctggacaagtgccggatagagaaacagctgcacataagggttgcgccttgccgagatattcatgatatcccggatggccgctcccgtaggagccgtcacgatccctacggtttttgcatgccttggaattggtttcttatattcaggggaaaacatccccatctcttccagttcatcacggagtttttggaacctttcaaataaatcgccgattccttcttttgtgatctcctgggcgtagagctgatatcttccgtcccgctcataaacctccacgctgccctttaccactacctgctgtccttcttccagtttaaaagcaagccctttcctgtggccggcaaacatcaccgctgccatggaagatttcccgtcttttaaggtaaagtaaatatggccggaggtatggtacttgcagttggacacctcgcctttgacagagatccggtttaaggcaaaatcctgggcaaacatatttttaatataagcattgacctgggtaacggaatatacacttgccataattacaccagctttgccaggactccgtttataaatgccggagattcattcccgccgtactttttagccagttccacagcttcattgatggctaccttttccggcacttcctcatcaaataaaatctcataaagggccaggcggagaatggtaagttccgccttacccatacgtttcgtcttccatccttcggctacttcgttgatctttgaatccagttccgggattctgaccattacggactctgccttttcccttaaataagcagcattctcttcactcatatcaacatcgtggatgatctcctccacgccctcggcgtttaggtcatcctctttcggttcctcaaaatattggataagctgcccggtcttctcctctgcgggataaaaatccgcacaaaagagcatcttaaagcagtgttcacgcaatttacttctggtcatttcccatggtcctcctattggtgattttctggacatttggaattattataccttaacagggttttttatacaatagaaactttcctgttctccaaaaacctccggatattatcaagcaccttttcacttaagatgccaaaggcctgcctggttcttccggccgaagcattgacgcagaatacctttggatgctttaaaagctctccggtaatatctccaattgctcccgcggtatcacaggcaaaccggttatcccccgcatccagccagttttttaaatcctccggctcaaaggcaggtccaatggatgtattaaagaggatctttccatttccaagcctttggaattcctcctcgtgaagcagaatcacgttcttgtttaaacaggtaaacaccacctcactgctctccaaaagctctaccaggggaagatacttcattccctttttttcatgatccggctttctgcttctgctgtaataggaaacatccgctcccagaaactttaaggcatcagcgatcattcctccggaaacacccattccaatgatccctgtctttaatccggtgatctccacaggcatatccttccacatgggcctgtcatatccgtgaaggaaccgcaccagctcacagatggcgtattccaccactcccgcatcaccgtaatcacggatccccagaactgtgatcccgtgttcttcggcataggcgatgtccacgttggcactttcctttgaataaaggctgcagcacatcccaacatactttacattagggcatctttcaaagacaaaccggctgattctggaggtatagcttaaaagcactccatccgcatctccgatccgccttacgatctcctcatcgtcacaaggaatgtcctcatacattaccacctgttttgcatagcgagaaagctctttctccgcctcttccaccaggcttaccggctcaatggcaactaatttctcaaacattttctcttcctccagtcaaacggatattcccgatccgcttcgcttcttgcttgattcggttaaaaaaccaccggtgacacaatgttttgcagcacagccaccacactccagccggcaatggcactgttgcttgaataaatatccaccaccgctttcactccgtcaatttccgcggtgatcttatgatcatccccgatcatttccggaacgctgtgaatgttcacctttgtcctatcagggcctgccgttgccagggaagacgctactgcgacattcacctttgtgggaagaagaccaatggcctcctttgcattgccttcaaacaccatggtgctttcttcatcagtcaacagatgctcccaaaaagaggggtatttcttaaggattccggtccctttctggtctcgatcccggctgttgcctctcccataagggaaaccgtgcggagcacatcaaatccgcctacagctcctgaggcaatgtataccctggtattatgttttttggctgtttccttcaccttttcataaaattcctgatctgcaaaggcgccgatggacagtacgatgaagttggagccatttgtcaggatcttttccgccatatccttaacggaagctacagatgctgcctcagcgatgtaatccggttttaattccagcagttcaccgatcccggagcaggacttacaacccatctcatttgccagggcatccgtcttttcctttgtccttcccataattcccaccagctcatattccggcaataaaccatctctccatgctcccgcaatgatttctccaagatatccgtttcctataattccaagcttaagcttattcatgcttttctccttttcgtagttttaaaaacagtcaagcggatatccgcaatccgcttcgctgcttacttaattcggttaaatttcattatacctgaaatccataggactttcaaggagaggcagaacaatgggcttacccgaaagcatcaaagctggagcgcaaactgattctttccttttctcttagcctggtataaggcctgatccgcccgttttaaaatggcatcgtattctgtttcttcttctcctaccagggtgattccaatgcttgcatgaatggttcctgaaacgtgaaacgcatttaatatccgttttgcaatggcctccggctgcttcctcccgctgacgccgtagagccatatgcagaattcatccccgccaaagcggacgatcacatcctcttgccttgtacagtcgattaagatctttcccgcctgggtcagaaccaggtctcccttttgatggccaaaggtgtcgttgatcttcttaaaatcatcaatatcaaggaacatacaggcataaaaccgttttttccctccggctctcagcccttgttccaccagctttttggctgtctccctggtataaacccctgttaaataatccttttgcgcccgtttggattcctttttccgcagatggagaatacagatgatcagcaaaaccgtacaggccagcaaaaaggtagaacctgcaacaaagcgttccgacagcctttcgatcctttgaagagtgctctcatagccttctgtttgcaccagagaagccaccatccagtccccgattcctgcaggctgataataaagaagctccctgctgccattgcggtcatagacagtatatccggaaagcccgctctccaccgccttttttagctgttccaaagactgcccgtccttaaaatccatgagcttcagcatatcgtaaatggtgccgtaattttcgtatccagggcagaaggccaccagttctccggtctttgtgaaaaccagattggctccgtacctgcttatttccgtgttatttaaatatttccccagttccgcaccggtatactccatgcaggctgctccctttacctgaccctcccttattacaggaaccgtcagaacgatcccccatggccgtcagaatcatttaaagacaatctggaaatgctgttctttccgcttaacgccctttggtaatcactgcttttggaaacatcccgtgactcattgtttccataatacatgatcccctggtcatcggaaatccccagccgtaagccccctgtttcaaacgtctctgaatttccccgccacttttctatatcctgtccttccggaggatcaccgtatgcagaaaatatttcaagcatttcaagcctgtcctggattattctctgaagttcagccaatgtcccgtcactttccttctccaaatcctgataagtctgttctatcaggatcttttccacctccttgaaataacaaatgtttaaagcgaatactcccacaattaccgtaaccaccaggccaaacaaaatcattaccttctgcgagtaatggtccttctccctatcagtcatcatatacgtaaacacctgtcccttaagaatccgttgatatattccgggttcattataaatcctgagcgaaatcattacaataaatttttactcatttatgcacaaagaaaagcgggggtatgaaccttttcccggttcgccccccgcgatagacttttctaaaaatctatttattctcttccaatgcaacaccggcaatccgaatgtttacatccaggaccgttaatcctgtcatgttctcaatagcgttctgcactttctcctgaactttctcactgacagcaggtatgctgtaaccgtatttgatgtttaaggataaatccacagatacgtgttcttcggtcagttctaccttaacgccttttgataaatttttcatgcccagcttcgccaccagctcattggtgatattgcccgccatggaatctacgccttctacttctgttgcggcaaggccagcaatgatggccaccacatcgtctgcaatctgtacttcgccgattttatctttttcatatactttgtgagtatttctgctttccacttctgccacagcaattccctcctgtactcatatttctgggttctggaattattatagcaaaactggccgaagtttgcaagttacagttagccatgcagaagtgtttgcacattatgaatggcatggctgaaacgtaacatttgccgcggctttttactcttccagtttcataagggtgatcacaatactctccgcccctacttctgttttcctctttacgatgtcctcaatctgggcccgctgaggatctgtaatgctgggagcattaatgaccacatccacttttccgctggagatgctgaccacagggtctgcaaagcctttggcaagcaataaggtttctgctgcattttctttttcagaaacagccgtcatttcgatcatttcctgaatggcctgctgttttgccgcttcctcaatgttaggattgttgattaagttcattaaggtttccttgttctttgcccttacctgctctctgtttaactgtacgcttgatatgtagtccgatacgttcattccgctggtaagcactgcttctccagggttgtcaaggccggtctgggccgcctgtgtctcatttgctgccagatccacggatccgtcgctttctgcagctgccaatgtctcattttcctccagcttatcgatatcttccgcatcctggtcaaggcttgcgatttcctgatttacatcactgcctgtaagggactggttttctgctaaaatatcttcttcagaaatatcagtcatccccgcctcatagacgtctgtcccggaagcggcctcctgctttccggcatagtttaaatatccagcagcagctatcataacggccaatgtggtgataataatctggtttcttcggaacagtttcttcatatccattttctttggggttttagggactttgggttcattgcttgttttccaacttctcatacatgacactcctttttattccaccctctttaatacttttattttatgtgggggcaggttaaataatgcttccatggcactggaaatttcagcttttaccgtggggctgcctccgccctgggcactgatgacgattccttctatctccggacgtatctccttctccacaattggagatgtgttttctcctgaaccggtaagaatagtgctttctttaagctctgcgctggtgttctttctggtcccccggagctgtccttttcctcggtagaggaatccgaactgtccttatcgacacgcagtaccttctcctctgacgatttcagcacgatcatcacttctacctgaccgaccccatccacggttttcaaaattttctttaccctcgcctccagctgctcctcataggtccggtctgctcctgccgccgcagccgcttctccatctgcaggctctgttacgattcctttttgcaatgccgtctggtttttgctttctgcagtccgctctaccttggcggccatacccgaaccggagggaaatgtaaggattaggataatcattccaacagccaataagatcagccatttatcctttcccatcttccatttgaatttcaatatcctgttcctccaaatcataatattccgcaatccgccttctaagacctgaaagccgtgaattttcttcctgtttctgcctcctcacgtcctcctgtcccttatcctcacctttttccggctctgacccggctattttcacctcttctacttcctgtaccttttctacgggaaccgtcccatttccggaaacagccacaccctttgcttcttctcctgttttctgcggcaccagaaccatggagacctgcattacatggccaaaggaaccgctttcctgatccttgttgatttccaccctggatgtcctgcagtcaaagccttcggtttctgccatggattttaaatccgttcccaccgcctcctcatatctggcaatcatggtttcaagccgtttctcatccatgcttgaaagctttcccgtcagctctcctgcttcctttttaagactgatggcctcaaaatagtaagccagggtatcatcaagccttaagcctcctgtaattggttttaataccaaaaggatcaacaccatgccggcaaataattttatgtacttttcatatttcttatccggcaggaggtttcccaccacggttataaaaatcaggtaataggttatattgcgtatccagttaaacaattcttccatgtctctcacccggtataataggtcacattggtggaagcgcatacaagcgctatggtaacaataaagagaatcacccctgaggccgcaacggaaaggagcatccgatggccttttgccatatcggaaatgcaggacacgatcctcttatcgcagaccggctgcaaaagggctgcaacgcattggtataataccatcagcaccaccagctttaacagcggaatcacggagatgatgagaagtatgataataccggctgctccaatggtatttttaataagcaccccggaccccagcaccatctgggcaacggagttaacaccctggccgatcccaggaatggctccgatcagcttctggatggctcccgttttcatggaatccacatagggcagaaccatggactgaatgaggtgaaacccgagcacaactcctaccagggtctttaaactccaggaaaccacctgttccaaaagctctgtaagctttgagagcatgtcctctttggcaatgtggcctgccatgaccaaaagggcatagacccttatgagagccaaaagcacctgccccaaaagccactgggcggaagcgatgataaataatgtgaactcataggaagctgccgcagacgcgctgctccccgcaaatgccgctgccaggaaataggccggcatcaatattttagtaaaatccatgacctgccccaccacatttcccgtaatggtaacactggtaaaaaagctggcagccagataagtaaacagcagcagataggtgacgaaaaacccggtttcagaaatctggcttcccgtaaacacgctggaaaagttggaaaataccgctccaatgatccccagcaccatgatctgtcccatcatatgtccgctgtttttaatctctcccatcagcagatccttcagcgcttttccggcctgtcccatgacttcatttaattttccatccatcagatccttcatcagctctttaaaggaaaggttcatgccctggttccccttagcctggtccagaaatttctggatatccgttaaatcatattgatctaaatccagctctcccactgaggccgcctcctcctgcccggaagagacttccgctccagggctgtcccccgggaaaagcagcaggatcaaaagacacaacaggaaaaaggcggttcttttcatggtcttactcccttccgtcatgataaaaatacctgcagcgtctcaatgagggccaggagaatgggcatgctgactgccagaacagacagctttccgaatatttcgatctgggtcccaacggctccgtatcccgcatccttgcatatcccggcagcaaattctgcgatataggtgattcctatcatctttaccagggtggatagatagatgctgttgatcttaatataggtctggatctccttcatggtatccagaatggtagtgagctttcccatgccgtaaaaaaagataaaaaagcccgccgccataaccagataggtcccatattcccccttcatcccttttaaggaaaccgctaaaagcactgcaacgatccctgttatggctatggtcactacggtcatgtctctcacctacaatgcaaacagatttttaatggattcaaataactgataaatataaggcaccagccagaacagcaccaggatcagccccgcgaggcttgttaagaatgcctgttcttcccgtccgctgtgttttaatacctggcagatgacggaaaccaggattccaactgctgcaattttaaaaatcaaattgacccccatgctatcctccttaatacattacgattgttaggaataaaccgcccattatacccaggctggtataaaggcggcttttttcctgcttatgttttctcaaatagccgatggttaaatccagctgttccaggtacaaaagaatgttccgctcctgcatgtccatgtctaagtatcccaggtgctcacccaggccttttaaattctgtttgtcctctttggacaagcagacctccctgggaagtttgtcgatctcttcctgccagatggtataaaaggtttctccctgctgtccggaaagccgctccgacaccttctcaaacaaaacgcctatttcacctccggcctttctgccggtgcgctcaaaagcctctgtaagaggagaatttgcataaacaatctcgccttttaacaaaaaaatcatcttccggagcttttccacggtctttaaatgctcgttccattgggctgccataaaaaacccaagaccggagctggatataatgaccagtactgctcctaaaatcctcagccacgtattatccataagcaatacactcccgcctgtcccatcgtattcccatctgatgtacctgggatttgtagagctgagttcctctggagtcatagatctgatcgatgtttccgatctttcctaagttgtttaagacaatatatctctcaaaaatccgttcctccaccagctttcttaatatgggcttctgctttaagtcatcgatggagttcccgtgaaccgttgcgatcagcttacagccgcagttcatcacgtattccattgcctctaaatcctccctgcttccgatctcatccacggcaatcaccctgggagacatggtccgtatcagcatcatcatcccttttgccttgggacagcagtctaaaatatcggtacggattcccagctcattctgagggatcccctgataacaggccccaatttcagaacgttcatcaaccacgcccaccgtaagccctgaatgatcctcagaaccattggaaacctgacggattaaatctcttaacagagtggtcttcccgcatctgggaggggaaatgatcagcgtgtgatagatttctctcccttcctcgtataaataaggcaaaacctctgaggcgcagccctttacctgatgggacagcctgacattgataaaggatatgtatttcattgccttgatcccggattcgtctaaaatggtctttcctgcgatcccgatccggtggcctccctgaatggtgataaaaccctgtttcatctcttcttcaaaagcatacagggaatagttgctcatgtactccatggtttccttaagctcatttttagagaccgcataggcgtcctttccttccttgctcagggaacctttcggagttacataatactcctcattccggtataccattaaaagaggagccgccacccggagtctgatttcctgaacctcgtcaaagtcaacggtcacccggtttaaaatttctcttatgctcctggaaaatatattgataagctcgtctttcctctccaccttcatccctcctcttacctcaatatatgtagggtgggacaaattatgactgaaaaacttccggcttctttcatcctgtttcttaagggaaaggggtgtaaattaaaaaagagcttatcccagatgatctttacaaaccatccggataagctcaaatgtgcctttttatttaatttcccaatactcttctcactgaaaccacaggcttaaaatccacagtggaaattttaattccgtcctccgggccgcttgcatggatcagctgattttgtcccacgtaaatgccgatatgccctatgtatgatacaagatcccctggccttgcattttctattccgcctacatcaatccctgcttgtccctggtcctcagaggttcttggaagatttatgccaaattgtttataaacgctcagtacaaacccggagcagtcagcacctgatgtaaggcttgtccctccatatacataagggtttcctaaaaactgctttgcataagccaccacctgttctcctgttccgttctggatttccggccctgtctgggaaaatccttttcccggaccggttcccgggccggtctgccattcagagggcggcggagccaccatgaggattgccatgtcggaggctgtatccgctttggcagtaaaatgattggtggtcataaatacaagacctgtaagcagggtaactatccacttttttctctgcattgttcttttctcctgatatgatatcgttatatgcccatatccgctgcatcttcggacaggaatctgtggtatgtgacgtgattttcatgaaatttgatataataccgataattatcaatagaaggattctcaaaaaacagaatgtaatcaaaatcttcttcctgggatttctcacaaatgaccctgccatccccgaatttacgaaagacttttaatatatcttccaaggcagtgctgtgattttccacggtttctatgaattcctttaagaaaccattgtctttttcatgctcatatacgtattccactccttccggcggaatctcaaagcaaaaacgttcctggctttttgtgatcctgatatctcccagacgttcctttacggattccttaaagccttccattgcggctttcatttccctgtcagagtcttcggagatcttcagtattttcgtcagtgcatgttgaggatagtaaaagcgaataggctctttttcatatcctaattttatctgtacttcttttatcgagttaatgagcatccgctccagcgcaccatattgcatatccatcactccagtcattttccagcagtacccaaaacaagcagatattcgcaatccgcttccatgtctgtcagttaaattatactgttccaggcgggacatgtcaaggttccggaaaacagcatttcctaacgggacaaaacgcgctccgcgagttttgtcccgttatcgcggcggtcgcccaatggacatgcaggcatgtccgctcggctcgccgcccgcataaaaaaagatgctgtttcccgtaagtcattggcgaggaaacagcatctgaacattaacttcttattaaatagtcaaaagcgcttaaggctgcactggctccggaacccattgcaatgacaatctgtttataaacgctgtccgtgcagtctcctgctgcaaagactcccggcacactggcagcattgcggttatcaacaacaatctctccaatgcggttgcgttcaacggtttctcccagccaatccgtattggctgcaaggccgatctgaacaaacactccctgcagttccacatgatggactgctccagattcacgttccacataggttattccgtttaccttatcagtgccggtaatttcttttgtctgaacattctttatgactgtcacattgggaaggctgaaaagacgcttctgcagtacagcatccgctttcagctcaggcataaattcaagcactgtcacatgacttgcaattcctgcaaggtcaatagccgcttcaatgccggaattaccgcctccaatgactgccacgtgttttcctttaaaaagaggaccgtcacaatggggacaataagcaactcccttgttcttaaactctgcctcacccggtacgcctacatttctccagcgggcacctgtggaaaggatcaccgccttgctttttaaaacagcgccgttttccagctccacctcgatgagttcttttctttccaggcgtttggcacgctgggaattcataatatccacatcgtaatttttaacatgctgctccagggtttctgcaaattcagggccttcggcatacgccacactgatgagattctcgatccccagcgtctctcttacctgaccgccgaagcgttcggcaactacacctgtacgaattcctttgcgcgccgcataaatggccgcgctggctcccgcagggccgcctccgatgacaagtatatcaaaaggctctttctcctcaaactctgatacatcagggctgctgcctaatttccccagaatctcttccagtgtcatgcgcccgctgccaaaaacctcaccgtttaagcagaccgtaggcacagccatgatatttttactttccgcctcatccttaaatgctgcaccgtctatcatggtatgggtgataccaggatttaaaatgctcattaagttaagggcctgcaccacttccgggcaattatggcagcttaagctgatataggtttcaaagtgaaactcacccttgatcctttttacctggtcaattaatttgccgtcaacctttggagctcttccgctcacctgtaagagagccagtaccagagaagtgaattcatggccaagagggattccggcaaaagccactccggtgtcttcccccacacggttaatgctaaagctgggtgttctgggcagctttacctgctctgtcttaattcttggggacagggcggtcagttcatctatcagagccttcatatccattgatacgctgtcagagccttcactgattttaatcagcacatcattttccagaagctggagatactcagccagttgttttttaatttcagcatccagcatcataatatttgctccttagatttttcctacaaggtcaaggcttggcttcaatgtggctccgccctctttccattttgccgggcaaacctctcctgggttatttcttacatactgggcagccttgatcttatcaataagaacgtttgcatcacggccaatgtttcccgcattgatttctacggactgaatgatgccatccggatcaacgataaaagtaccccggtctgcaagtccatctgcttcaatcagcacatcaaaattacgggacaaggtatgagagggatccccaatcataatataggtcaatttacggatagcttcggaattgtcatgccatgccttgtgggtaaaatgagtatccgtagaaacggaataaacctctgctcccagtttcttaaatgtctcgtaattgttctgtaaatcttccagctccgtcgggcatacaaaggtgaaatctgcgggataaaagcagatgatgctccactttcccttaaaatctgcttctgtaacctctacgaattcaccgttatgaaaagcctgggccttgaatggttttacttctgttccgattaatgacataataattacctcctgtgttttatatttataatttgaccgaattgcagctatcgctgctattcggttatgcccgataaagcagggttgaatatctttaaatcttattgatattctttatcaataatagtaatgattactgatattgttataatatagcattccaatcagattgtcaagtgactttttccaaaattttgattctttttaaccttcttaattaataagtaaggatatgaaagaaggaaatccggatcagtggttcaagctttatatgcttttttcatttttaatatacagccttttgtatcactgaaaaagtccgtctgttcaactggaatgaaaagaagagacagcggccgcccacaaaggctccgctgtctttaaaacagatggatcatcacttggtttttcatcagtaatcaacacccttgtccattttgacaaaagaaatactcccatttctcttccgcttctgaccggacggcttccttttttatctgcaggatcatcccgtctttcactttcccctttggagacaaaacttcgctgccgtttaaaatcagcccgtcctcacaccatttctttattctgcttctggatacggacagctgtttcatcaaaaaaacatcagctcttaaatcaaatccagacggaatcctgatttcaatttccatggcatggtcctttccgcagggaaatgcagtatccacagtcgtcacgtggtattcctcttttgaggcagctgcctccgccttattgcgggcaaatatttccctgtcatttccgtattttgctgccagatcaggatcattgtttaaaaatccttcatactctttcttttctaagcggcctgcctccacccgttcccacagggtcatattccaggaggtctcgcattgtccgcaccggtagaccagccagacgtctaaaagacggccgttggcgttgaccctgaattttccgctgtttataaattccgtcttttttccgcatttggggcaccttcttatgatggctggaagctggtccggcgtgacgatccattgttttcgtaaattacgattcatgttctttctccatttttacaattgtttctcagacaactgtaacacgccctctttttttatcccacctcatactcatttatgaaataaagaaaaggcggcacaccattttctatttgatgtgccgccctatttcatttccatatttttcttttcctgaagtacgatcctctggatgcttttctcggataagtaatagcgctctgctaaaagcctcacgcatataccggatacataatcctcataaatagatacatcccggcgtttcctttcctctctggctcctgtcctctggccccaggttcgtttattttcctgttttctggggatgtaaacatattccccgtctatataattctgaattaattccaccagctcttccggtaaaatttcattggctttctgatagcgcatcgctgcctcccaaacatatttttactgtcaggaatagcaaaggctatacaattactcttttattttaactgcataacccgtgctatgcagtctttgagggttccatcataaaaaaatcgcctccttaaagaaacgcttatcttgcaacataattacagccattttatcaccacgagggctcattaaaaacctcattcttgattcagaaacgtatttgagcagcaaagtgtcagctttttatgacaactcctaaatactttgccagttctgctgcctggtataaatccaccactgcaccttttatctccgggcagccgtcagacagaaccaacccctgtatcatgctgctggtaaaatccattcctctcattacggttttaaaaaaactggcgttttccagatttgcccggttccattctaccgccttacagcggcattgagtcaggaagccgccgcggatctgagtatcagaaaagcggatgtgttccagcctggaagaatcaaaattcccatagttgaaattacagtcaaggatcaccgtatgaagcatggtatttccgcaaaactttacgcccagcccctttgaggagaggaattccgtccggttaaaatagctgtcctcaaaattgcagttggatatatcacaggcgcgaaacaccacatcagtaaattcccctttttcaaaggtgcaatcctgaaatatacagttctcaaatatgacggcggaaaaacgcatgcgggaaaggtcttcctccgctatatgaaggtttcttatgagtacatctgttaccgcttcctcctggtcttttctgcgggataattcctccatatcttccagtacaaaatccattgtctccggaaggattggggtaagaagtttctggcccatataccctatcctttctcatctttttatccaaagggtctctccctctgtggtgtctttcacttaacagactgtcttttatttttcagcttccatatcatctgacagtttaaacgaaatgatctgttccttatattaccagactatcatggaactttcaagttcctggaaggcgaaacagctgtaatactttttgttttttatccgtcagagggcaggtatcggccgttccgttacgggtgattgatctctggcttcttagaaaatgtcacaatcaggctgtttaggatcatgcccaacacaataaaagatataccgatcattcccagataatcaggctgtgaatccccaaggagccagatgccccccagcaaagtaaatatgacctcacctgactgtgtggattcgatcacagcaagctgcttatggtttgacttgaccagatcggtggctttaaaaaacagcagggttgcgatcactccggaaaaaactgcgacgcacagggactggagggtctgatttacagaagggcctccggtatttaccaggccaaatacagctaaaacaaaccagaaggggaggctgcataacgtcatgccgtaggtgcgttggattgtagaaagctgatccccgcttgcctccatgatttttctgtttcccaggggataggagacagcccctataaggataggaagcagcgtcataagggtcctcttaatatccagatcagctatatcatgtacctgcaaaagaaatactccgattaaaatgaatcctgatatacataggttttttatgggtacacgtttatgaaatacaggagacaataagatacccattacgattgttacctgccaggatgccgcaatcaaccaggattccccgtaatcggccgcataagagagcggtgcataaaaaaagccgaatccaacagtactccaaatgagccaattgaaaagattctttcttatgactttatggacatgctgaaatccgcggtgttttcccacaatcatagccagaatgggaaaagtaaacaaatagcgaaggcttgcgctccagatccagcttcctccggataagtgcatgctgcggttgaacacaaatgtaaatgcaaaaaagaaagatccggcaataccaaatataagtgcttttttcatatttttcttatgtactccattatgtcatcatcgggtaaaaaataatgttcaggatgcagcacgtttcctttgaagagttgatatagcaatgaggaacatcagctttaaaacgaaaacactgggtttcggtcaaaacagtctcatcctgattcaggcgcatttccaattgtcctttctggacaaagatatattcttccacgccatccatatgtctggcggattggtgaacgcaccccggctcaaattcgatatacagcatctctaagttctgagcaggattatagggaaaaaggggaaggtccgcatcttttcgttttcctcataaacaggctgggtattcaatgtgtctattttggtgtaattactcttttcctgctctaaaaaataggtgagcggaaccttgtaccctgtggagattttccaaagtgttgtgatagtaggcatagactgcccacgctcgatctggctcagcatggccttgctgatcccggttaaatccgccgcctgatctaagcttaactgcttgctgttgcgtactgctttcattcgctctacaatgattgattttaagtcattcatactgttcaccatctattataacgtatttttttcatcataacatatagggaaggcaaagtaaatactaaaaaatccatgaattcaaaacatcataaagagcagtctgcagaaaaagccaaatgatataaacatttctatatttttgcgcctggttctgatataattaagtaaaatgggaatcttctgttagtctttaactgttgatcatttatacttgacgaaagaaaataggtgaatactatggttgaaacaatatattttgcaggtggctgcctatggggtgtacaagcatttatcaaaacactaaaaggtgttattcatactcaggctggacgggcaaatggttactcaaatactctcgaaggcgagtatgatggttatgctgaatgcgtaaaaacagaatttgaccctgatattgtatctgtttcccaactaatggattatttttttgagatcatagatccttacagtatgaataaacaagggaatgatgtgggaaaaaaataccgcacaggcgtatatagtaaagtgccccgacatttggaagatgctaagaattatataatagaaagagcagatagggacaaaattgcagtggaagtcctgccacttatgaattacgttaaaagtgcagaggaacatcaggatagattagataggtgcccgaatgactattgccatattccgaaagagttattacataaatattcataaccaacagttatgggcataatgagaattctggaaaaaagaaaatactggaatacagtttatctgcaatctgcggagccagtaattataccggctccaaaagttattatctgccttctgtctttccgggtgctgatcaagcattgggtatccccggccttccatctatgtacaaacattccaatcatttaccttttaacactttaaatggaatccccccatcctgccatccaatcatcacatttactatagtgggcaaaatcaatgtgaacaggttaatataagacacaagagtcagccccttggacaccaggcttgtaagcccaacctgggagacgccccaggtaagtatgatataaagcaaggtgagcattgctcctctcctgttccgttttgcagcggaaacttcaggattttcacttattttcccctggtaccagtttaaaacccggtcattgaagccctgagcataattgattgccgttgaaatcgttgcaaaaaagatggaaacagtgatcagggtcagcagcacggccttaaatgcggaagctcccaccccgttttccactaccaggatggtataaacagctttgccggccttccagccttcaaatactccggaataatttgccgccagatttatcaccgtcatctccagaaacgcccagtttaaaatgacggaaagcaccaccgcccagcggagagtccttttattggtaaagagctgggcatggtttacatacgccccaaatccgcctaaattctgacccgaaaaaatataggcccagcagaatgcggtcaaaaggtattttagaaagctgccggctccggaggaaattccctggttcagtgagccgcccatcacctgcatttcatttcttaaatttccgtttgccagattgtagatcacgtttggcacatgaatcacaaccagagtgataaaaatgactgcgctcataaacaccgcatttttgcgcaccaggccgcttcctttcatgcagagtataaacatgataatgcccacaacaaacgtggttacaagatatggcatgccggaaatctccgcaagggctgaacctgaggaggaataggccagagccatacatacaatgagcagccagttaaaattgaattcatatacgatttgcattggctttgccagctttcctcctaaaaaacgcgccccatatgctccaaggaagcttccataatcaaaggttctgaaatccatggcaaatttcataaagaaatagatcataaaacagttgatggccgcaactaccaggggcatgaacaggcagaaataaggctgcgttactttgggcaaaatcccgtaaaaccctgtgtttgcaaaaaaataagaccagggtgttgatccggcagcaaaaccgccgccgcattgagagctgaacgctatggatacgaatacgacaaccgtcttccagtcaatttccttaactccagctttgtttccatttcccccatttcccatggtaagatcctcctcgtataattatttgttatttttttaacaaatagatgaaaaataaaatatctctgctcttttctgccggctgcttttgcaggttctttaatatttagattcattatagtttatggctgatggaatatccaatcggccgattctatgcattcccgcctgatccatagtttttttcctatatatttatttaataccttgtatcatcccttctgactgtgttatagtgcagaataataatatcgtcatacgggaggtaatggaaatgagagaagaaattatggaagggatcagacgccatattcttcctttaagcggcttggaaaaggcacagcttttggaagtatggcctggccattcaaagatatccattgagatcccggagagcgccttaaacttatacggtaatctacacggaggttttttattttctctatgtgacataaccgcaggcatggccacctatgcatatgaatataccaatgtgacccagcacgggtctcttgactttatgcgcggtatcaaagccggcctgatatttgtggaagccaattccatacacaaggggagccggtcggtggtaaaccgggttgaggtaaaatcagaagacgggaaaatcattgcggcaggggactttaccatgtatctgctggaggcgctgtaaaaacatataaaaataaaaagagagagcatggatttttgccaaagcagaaaacccatgctctctctttttgctcatctgcggctccacccatatcccaattaatccctgcttgtaaaaaataaatacatagacagcaactatcaatcatgcccaaaaagccgaatacagccgattggatttttaaagacccggtgtttataataaatgtatcaagattgttaaaaaaatactaatcaaaatctttaggaggaatgaaacatgagtaaattatccaaagaagaatttcaggcatatttaatgcagatccggaagctggcagaaggtcccctggaggagatccagaaggaagtggaaatcactaacaaatttccacaggaattctatgatctggccattcagaatgatttataccgctgttcgctgccaatagaattcggcggctatggtttatccgagctggagatccttcaggtacaggaggaattttccagaggaccgggcggcatgagaatgcatctccactatgcaatggatttaaactggagaatcttagatgactacggcaacgaggaactgaaagcagaatatatgaacaaattccaggataaatccgtatttacctgctttgcactgacagaagcaaccggaggaactggcgctgacttacataccatggctgtaaaagacggtgactcctatgtattaaacggagaaaaaacactcatctcccacacggactgctgcgaatttgcttatgtcattgcagtcaccaacccggattccaataaaaatgacaggctgtccgcattcttcgtgccaatggatgctccgggttttgaagtcatcaacatgcctcatatgatgggctgccggggagccggacatggagagcttaaattcacggattgcagaatcgacaagaaatacctgttgggcaaagaaggccagggccttgaaatcgcaatgcattccttatccgtttcccgtgcccacattgcggcaagcaatctgggaatggcacagagaatgctggaactgtccctccagtatgcagctgaccgtgtaacctttgggaaaccgatcggaacccgtcaggccattcgctgcaagatcgccgatatgtccatgatggtacacgcacttcgctgcatggtttatgactttgcaaaatcttatgaggagaacccaaccggcgaatacatcgaagaaaaggcagccatgtgcaagcttttcagcattgacactaccagaaaagtcagtgacgaaatgctggagatcttcggcggtgtcggttactttgaggattgcaaatatggtccggtggaacgtctttaccgtgactgccgcgccatgtggttagaggaaggtgctcctaccgtacagcgcatcaccatctcaaaaaacaccatcaaacatggggctaagatggaatatatcttttaataatgatttgacttggggtcatcaggttcggtctggacctaatgaccctgcttttgtaaaggaggaaattgatgaaaccattagaaggagtaaaagtagttgacttaaccacctatttagcagcccccaccactgtccgcgtacttggagaatggggagccgactgcattaagatcgagtctgccaaaggggatccggccagaacacagggagcggtgttcaacatgccctatgaggatgatgaaaatctggcatttgacgtagcgaatatgaacaaacggttcattaccctggacttaaggtcagaaaagggaattgaaatagcctataagcttttagaagaagcagacgtttttgtcaccaataccagaacaaaatccttaaaaaagctggggcttgactatgacaccttaaaagagaagtttccaagactgatctttgcacaggttcttggctacggggaaaacgggccggaaaaagataccgcaggctttgatgtcacctgctatatggcaagagggggcgtattcggtaccaccgtaaacaggggcgatgcgcccatgattcccaccaacggctttggtgatttccaggtggccttaggacttgcgtccggaatctgcgccgctctttacgcccgggaaaaatccggtgaaggcgacaaggtcaccgtaggccttcaccattctgcagtatatgcgctgagcacaggagtcatctccgcccagtacggaaaccagtatcccaagagccggaaggaagtccccaatccatttaataacgtataccgcaccagtgaccagaaatgggtggtcatctgctgtccggagtatgaccgggactacgagaaaatcatgaccctccttggcagagcggacatggtgggaaatgaacgttatatgaaatgtgcccaggtaaatgctgacaacttaaaccatgaagtcattgacatcctggatgaagccattggcacgttcacaagaaaagaacttcttgccatgttcaaagaaaacgatctggcctgtgaggcggcatacgagccccttgatatgtatgacgatgaacaggtttgggccaacaacatcattgcaaagatcccctatccttccggagaacgctgcatgcctacaaacccggtaaatttcagttctcttggcgtaccggaatatcacatcggcggctcccagggcgctcatacggttgagatcctgaagcatctggattatgccaacggagagatcgaagaaattctggcttccggtgctgccaccggcgaaacaaaactgaaaaagctttgaaaaatcaaatggaaaggtgagatgacatgagtttactatacaccgaagaacaaaaggaactgctggctcttgtaagggatatggcggaaaacgaaatcaagccccgtgtccaggaagcagacgaaaagggcgaatgtcccagagaactgtttaaatggggatttgacatgggactgcatatgctggagattccggaagaatacggcggaaccggcttaagctatgaaaccacggccatgatttttgaagagctggcaaaagtagatgccggttatgccattacctttgtaactacctttgttgccttaagaaacgtaatcctggcaggaaccagggaacagggacagtattttgccgacaaaattgcccccggcggatttgcaggctttgccttaaccgaaccaaacgcaggctccgatccggctgccatgcgggcaactgctgtgttggacggggatgaatacatattaaacggtacaaaaactttcattaccaatggcgctctgtctgatgtatttgtgggcttttttaagacaacacctggggcaggacacaaaggaatctccgcatttatcatcgatggggatacccccggagtaacggtaggtgcccatgaaaataagatgggccttcgtctttccaacacaacggacttgatttttgagaatgtccgggtaaaggcctctgccatggtgggaccggagggctccggctttaagcttgcattaaatgccctgaacttatcccgtgcctttgttgccactctggccgtgggcatcatgcagagagctcttgatgaatctgtaaaatacgcaaaggaacggaaacagttcggctctccgcttattaaattccagatggttcaggccatgctggcagatatggcgatcaaggtggaagcttccaggtgtctggtcaacaacaccatgaggatgatggatcagggaatcatggtccaaaaagaaggctccatctgcaagacctttgtatccgactgcgcccaggaggtgacctccaacgccgtacagattttcggcggatacggattcagcaaagagtatccggttgaaaagctgatgagggactgcaaagtattccagatctttgaaggcgcaaaccagattcagagaatgaccatcgcaggcgtattggataaggaatataaataagggggaatgaaaatgaatatcgttgtttgtataaaacaggttcctgataccacggaaatcaagatcgacccggtaaaaaacactttgatccgtaccggagtccccagtatcatgaatccttttgataaaaatgcattggagacaggacttcagttaaaggatcagtacggcggcaaggtaacggtgatctccatggggcctccccaggcaaaggccgtgttaagggaagctctttccatgggcgctgatgaagcgtatctcatcaccgaccgggcattcggaggctccgatacttatgctaccagctatatcctttcccaggcaattaagaagctggggacctttgatgtgatcctgggaggcaaacaggccattgacggggataccggccagacggctcccagcattgcagagcaccttggagcggtcaggctcacctatattctggatttaaaagtggatggtgacaaggtcatcgcacgccgtcaggtggaggaagggatcgaagtcattgaggccggactcccggttttgtgcacggcaaccaaagaaagcaacaagcccagatatgctaccatcaggaataaaatcgcctccttaaaagctgagattccggaaataacgctggcagaccttcccggctctgataccaccaaaatgggattaaagggctctcccaccaaagttaaagcaacctttacccctaaaagatctgcggacggcgtgaccataacagggaacaatcccggagaaatcgcatgctcactgatcagcaggctggccgatgggaaaatactgtagaaggaggttttaagtgatgagttttgaaacatgtaaagacgtatgggtattgattgagtgctttagcggccggccaaaaagcgttgggcttgaactcctgggacagggcagaaagcttgcccttggattaaaacaggaattatgtgccgttgttattggaaaagaaacggaggaggcggtgaaagctgccggtgagtatggagccgataagatctatgtggtgcagggtgatgagtatgagcattattcagcggatgcctatggccatgtgttcctggaattatgtaagaagtatgatcccaataccattttagtgggtgcaaccgcaaacggaagggatctaggttctaagatcgcagtcagccttcggaccggactgaccgcagactgtaccgcattaagtgttgatgaggtaaccagaaacgtagtatgggaacgacctgcctttggtggaaacttatacgcccagatcctctgcagcgaaaccagaccccaaatgggaacctgcaggcccggcgcatttaaaaaaccggaaaaaacaccggataaccgtccggtcatcattcaggaagaaataaagacaccggaacaggaaatccgtacaaaagtcattgattttctaaatgcctgtgaagacaatgatttgcgccttgatgacgcagaagtcatcgtatccggcggacgaggcatgaaatcagcagaaaacttttctatcttaagagaactggctgatgtattgtgcggaaccgtcggctgctcccgtgcagccgtggacgcaggctggatgccccagtccaggcaggtgggccagaccggttccaccgtgtcaccaaaaatttactttgcctgcggaatatcaggagcagtacagcatgtggccggcatgagcgaatcagggacaattatcgcgattaataaagatgaaacagctcctatttttgaagttgcggattattgtatcgttggagatgtattcgaaatcattcccgccctggtaaaagaattaaaagcgaaaaaacaggggtaatgcggaatgcagcttctcttttatccaaaggaggcgggttatgtttgaagaaattaaaatcaatccccacctgaaacgtcagtatctggaaaaaggcttctggacagacagaactttactggactgctgggaggagtcggtgaaatgtcatccggaccgtgaatatgtggtggatgacagaggctttcgatatacatacaggcaaatggacgaaggtgcttcaaaagtggcggcctttctcctgagcaaagggataaaaccacgggacacagtctcttaccaggtccctgtgtggagcgaatttgttatgatcaccattgcctgttttaaagccggcgcagcggcacatcctattgcaatgtcttatgaagagaaagaactggtgcacagcataaatctgacggaatccaaagcatactttgggcccacgttcttctataaaactgattatgaaaaacagatcttgtcggtaaaggatcagattcccggtttaaaaaccattatcttgctggactatgcaagagaaaaggcaagtgacaatataaccatgaatgagatccttaagcagtatgaaccgcttaagccgaagcaaagcctccccttaaccggccaggatattgccgtaattctaggcacctccggaactacctgcgggacaaagggagtactgctgacccatgacaatgtcagatacagtgaggaaacatttaataaagaacttgggctgacaaaagaagacatcatgtttatgccggcacccttaaaccatgccaccggtttccatcatggcatcattgcaaccatgctcataggggcgaagctggtgctgcagcaaaaatactgctgccgggaagccatcaacttaatgaatcaggaaaaatgtacctattccatgggagccaccccctttatttacgatatcctgcgggacttggagaacaacggaggagcgctgccctatcttcggttctatctctgcggaggcgctccggtccctggctatatggtacaaaaggcatggaacttcggaatccttctctgtgaggtatatggttccacggaaagtgttcctcatgtatatgtcagacctgaccaggtgctgtccttaaacgggtcgacttcaggaagagccatggagggcatagaaatccgggtgattgatgacgatggaaaggatgtccctcccggcactccgggcgaagagctttccagaggtcccaatgtttttgtgggctatttaaaaaaccggaagatcacggatgaagccctggatgacgaaggatggtttcacagcggagatatctgcgtgatggatgaaaccggcaatatccgaatcatcgggcggaaaaaagatatcattgtccggggcggagaaaatttaaattctaatgagatcaatgacaatttagaaggttgtcccggagtggcggagcatacggtaattggtatgcccgatgaacggctgggagaacggatctgtgcatttgtggttcccctttcagaccataaggatttaactcttcatgatgtaattgcctttttaaaagaaaaaaacgtgccgaaacgattctggccggaaaggctggagctgatcgacagaatccccatacaggcagcggtaaggtaaaaaaatacctgctgagggaagaacttattaagagaatgaggggatgacaggcaatgactgaacagaaattcggaccaagaagatgccgagatacaagaaaaccaccggcaggccaatgccctgaggttgttttttatcgctgcggggaatgcagaaccctgtttccggtcaccggagaaaaggcattggaggaaaaagaaattctctgctgcaatcataaagcagaacgcctggtcccatccgccccggaacaggcagaagacaaaataaaggtcagctaccagatcaccggcggctacaatgacaatgctgtccaggttttctggaaggcagagaagcttaaatacgcaccggagtggatctatttaaaaacatttaccggcggatatttgaaatatgtggctgaaacgaaacggccgccaatggtatttgcactggcagataccgatgcattcgcatactgtgatgaggatccatgcctggaatgtgtgttccgatgcaagcggggatttgtgatttatatctattcaatggaagcggggcttgttcatctcccacttgataaaatgacggcccattggcagtcaggagcaaaagaaaaagcataaaaactatttaatattggagggaaacttatgttagctacgatcggtttgataattgccatcacgcttctggtcattatgattatcaaaggcatcgatatgattacagcaacggtgatcacagcatctattatcctggtgaccagcggactgaattttaaggaaggacttctcaccaccttttccggcggtgcaggcgctttcgttgcatcctggtttttgatcctgggactaggcggcgtcttcggacagctggtgctggagaccgggcttgctacaaaaatcgccaagacccttacagaaaaacttgggacaaaaatggtgggattggtaatcctgatctgtaccttttttatcaccctgcttggtatcaacggatacatcatggtatttgtcttataccccatcgcagataacctgctgcgccagaataaaatggaccgccgggtgctgccctttctccttctgggcggcggcgcatctgccaacggctttgcatattccctggatatctgtaatgtattgccaagcaattacttaggcacttctcttggatctgccccattattatccgttatatttaccggaatcctggcggtatgttatttcgtatattttaattacgcccaaaagcagagccataaaaaccatacggaacaggagcttctggccatgtataaggacaacaccaccgccgtaaatgatgaggaacttcctgggatttttatctctgttctgccttttatcctggttttaggatcagtggttgtcacctccggctggggtacatcacccagtatcatgttttctctggtccttggcatacttttgatcatctgcacacaattgaaacacatcaaaaatatgaagtcatccattaagaccggaagcagctcaggcttaagttccatgcttacggtagcggcagtcatgggactttccaaagtcctgggtgcctctcctgcttttcagagtctccagcaggcggtactggcgatgaacatgcctgcatatttaaaggccttctttggcaccacggtcctgaccggcttaaccggctcagccatctccggcgaaaccatctttatggaaagttttgggcaggcgtttgtagacatgggcgtcaatatccaggctttgcaccgtattgtcacagaatcagccttaatcctaaataagctgcccaactcttctgttgcgatcctgaccatgtccatctgcggctgcagcctgaaagagagctataagcatattatcctgggcaccaccatcccggcctttgcggcaggacttattatcgcccttttggccactgcaggggttgtattctaaatatatttccatataaaaaggggagccatcgtcaagacagcgccctcttttttgcatccggccggatgcttatggcagattcatttcatgtgcaacaataaaatccgcaaaagcttctacagcagatgatataaaattctttttgctgtaagtcatatagatcagacgggtgtccgcgggaacatcggtcagtttaatgagaaccaggttatcaaactgttttaaaaacggagtcctggcgacaatggcggccagctggttctcggaaatgacaccgccgatggaaatctcatcatcataggaaaaggtggcttccaccccatgttcatttaagagtcccctcaccacctttccaatggggatggaatcccggtatgtagtaagcttataatcctttaaatcgctgagacggacctcctgcctgcctgccagaggatgggtgtcattgacgatcaaaaccagctcctgtgccataatcggcacaaacaccagatcaggctcatcatccaccatggagcagaatcccagatcaaatttacctgccgccaccccatgggccacttcaatggacattccatggaatatattgaattttgtctgggcaccttttttcatataattctggatcgcagttggcagaaagtctcctacaagcgttggaatgcagcccacatcaatgacaccgccgatctgcccggagtgccgcttcatagaagcaatcccccgctccaattcgttcaacgcctgggacacatgaacgtaaaattcctgtccgtattttgtaagcttcacattgcgtcctttcttctgaaacaaggaaatccccaattcctgttccaaagatgcaatggaatcacttaaggagggctgggatatatacagttcctttgcggccttggtataatgctgaagctctgccagtttcaggaaatagtatagctgtggcaaattcatgtgaaaccccctgtatgttttgtccaaaaattaacatagttctactgccaattatataaaaaagggcacggtttgacaaccttatttatgatttctgcaccaaaatgccatgaaacttcttttgaaaaacaggctttgtcacttaagtgaggttctatatagtgtatacagggataaaacatagaagcgccggagaccggcgcttcccttctactgaatttttttaaataattccacaagcttttctttatcaaagaaaaccggattggctcctgcacacgcatctttcatggcattttccgccagcaagtcaaaatccggctcatccactccaagctcttttaaagactccggaatattaacttcttttgataactccttcattttcctgatgacatcatcaacacattgctgatctgatttcccttttgtatcacagccggcagcttcggcaattaaccgaaaacgttccggcacatgctttgcattctcttcctccacaacaggcaggagcatcgcattacatacaccgtggggcagatcataaaggccgcccaattggtgggccatcgcatgaacattaccaagcccggcattactgaaagcaattccatttaaaaagcacgcatatcccatctgctctcttgcctcaatatcgtttccatcctttacggcacccggcagatactcaaagatttgtttgattgcgtacagcgccgttgcatcagtaacatccatggctcccttggcaactacagcttccactgcatgtgtcaaagcatccatgccggtcgctgccgttaaggctgccggtttttccagcatcagttccggatcatttacagtaatctcagccagggtgttggaatccaccattatcattttcacatggcgtttctcatctgtaatcacataattaatcgtcacttctgccgatgtgccggcggttgttgttattgcaacaataggcagagactttctggcagacttgttgataccttcataatcagtaatctgtccgccgtttgctgccaaaacagcaattgcctttccacaatcctgggggaaccgcctcccacagaaacaataaaatcgcaattttctttctgtaaaagctccagacctttatttacgttatcaatggtaggattgggttttgcttccgtgtaaaccgcatatcctatattcacagcatcaagaatggccgtgaccttttcaactgtaccgtttttcttcaaaaaaccatcactgacaaccaatgcctttttacagcccaatttccggatcggttccttcagttcctttaagcaccctctccccattaagtttactggcggaatataataaatcataagtattctccttttctttattctacggattctattaatgccaaagcctcagtgacagattccttccttacctggtcaaacgggaacatggactgagagcaaatatccagcccttttgcctttagcaccgctttgaacagaccggaacaattggtttccagctgataaagacgcatcagcttatggatttttttcttatatgtaataacctcctcccagttttccatatttcttgcttttacccagcctgcccataatccgggcagcagattggaaatagctccgatggaaccttgtccgccgtaatcaatattatcaagaaactggtcatcaaaaccggaatacatttgaaaatccggaaattcatcctgaatcaggtccaggacatctcttgtatgagtaaaagaagaaaccgattctttcattcctacgatatttttatgtttgcgcagcaagcgcaaaacggtttccggctcaaatgttgaatttgttctggcaggaaaattatacaggtacacatttccttcaatccgggaagccagaaagtcataataatggaaaatctcctcctgggatattccgtaataatactggccgataacgagaactccatccgcgccattttgcaaagcaaagttggacagctttaccgtttcctcgtgattgatacagcctgttccgggcagcacctttactgctccgcttatttccttcagataaaactccagaaactttttcttttcttcaaaaggaaggatggtaaattcaccggtactgccaaggggtaccacgccatcaacgccattgtctaccagatgacggatcaacgttccattgccttcataatcaattgcaccttcctgattaaaaatggtgagggttggggttactatttttgctttcatgctgtctcctatcctgctattttaattacaccatatacaatggttgataccgttaccatgcaaaagccaatgaatgattcataagcaatcaatttcagtctctcattgattttcatattcacacaaccggcactgacatggaaaaatgaaccgtggggaagtccgtcaaacacaaagcttccggcgtggatcatggcaccggctgccagtgctgcaacaccgtaagaaagaatggtatcaccaaaaatctggctggctaaggtcgtgcctgctgtggaagaagcggaagccgctcccataagggttccagatattggcgcaagcagaaatcccggcaaaccggctttttgcagcaattggacaatcacctcttttagggtggaattggcaatgattccggccagtgttccggttcctatgagcagcattgccacgccgctcatttttcccagtccgaattccaggtatgatacaaaatcttttaactttcccattacggccatacctaccaggccgcccaccggaagggcaatcaatggatcaatggtaatacctgcaaccggccttaacagcagcagcataatggtcacaagcggcccagccaatgcactgccaagggagggcagcagagcggtatccgccccgtcgctgtcagccgcaacatctgtccctttataagccaggcttttggcaaggagtgttgtaatcacaatagctgtcaatgcggcgggaattcctgccgccatcatggaagtaagcgggacatgaaaggtctctgctgcggcaattccgttgggatttggactcattacattgccggccttaacgccgccgatcatggccagcaatatgccaagtttcttatatcctgttttctgggctatctgaatggcaatcggtgatacggttatgatcgcaacatcaccgaaaacaccgattgccgtaagcagccaggtggccagagtcattgccagcatggaatttttatcacccagtttttccacaatggaattggcaatccgggctgctgcccctgatttaatcaaagctcctgccagcacaccggcagccacaattcgaataattgccgacacaatatcctttgttccgtttatcatataagttaccgtattggccagcccggctccgccgattaagccgcccacaacagcgcccgctatcatggcatatgtaggagggacctttttcaaaattaaaacgatggcaactaccagagccaatattgctcctaatgctgatacactcataggtttttacctctttctcttatgattcattaaatcttcaaaattccgccctctgaaccggaagctgcaaatttggagtaaagcgctaaatatcccctcttaaacttcggctccggccgcttccagccttccattctcccagcgatctcatcatcactaaccagcaggttaatgcttctgttttccacatcgatctcaatcttatctccgtcttttacaattgcaatgggtccaccttcagctgcttccggggaaatatgaccgacaaaacacccgttgttggttcctgaaaatctgccgtcagtaatcagtgctgtagtcagcgccaatcctcttccatagagatacttcatggctttgaacatttccctcattcccggtccgcctttgggtccttcataacggattaccacaacatgcccatcccgtacttttcctgccagaatcgcctcttccgctgcctcttcactgtcaaagcagatcgcttcaccggtaaaatggtaaagactcttatcaaatgctcctggtttcgtcacaccggtgtcaggagcaagatttcctcttaacacagcgacaccgccctggaaaccaaaggatcttctgccgttttaattacccttgggtccgccggatatgcatatatgtgattttcgatattttctcttactgtttttcctgtgactgtcatctcatctaaatcaatctgttcttttaatgcttccattacccggggtactcctccggcccggtgaaaatcaatgcaattatactggctggaaggattaatcttggcaacctgcggcgttttccggctaagctcgtcaaattcttccaatacattgatatccagttctgcttcgtgagcaattgcggttaaatgcattacggcattggtacttccactgattgccatacagactttgatggcattcctgattgactcatttgtaataacttttcttgctgtcaccttatttctggtcagttccacaatcttaattcctgtttcttctgcgattctaaaacgctcggctgatgtggccggagccatgcccccattaggcggcgtcatccccagggcttccgacaggcagcacatagtattggcagttccaagatatgaacaggagccacagcttggacagcttaaatcttccagcttcttatattcttcctccgtgatcttattggcacttaacatccctaatgcttccgcactggaggtctggtctgactgacggccgtcaaatacaattccgccttccatgggaccgcctggcaaaagaatgcaggggatgtcaagccgggccgccgccatcagcattcccggaacaatcttgtcacatgatcccagtaaaacaatcgcatccaggagctgggcctgggcaaaggtctcaatactgtcgctgataatctggcgggagggaagaataaaatgcattccgtcatgtccctgggccattccgtcacagcatgcaatggtgccgaattctactgcggttccaccggcacggttaataccgtctcttactttctgtgccacctgacgcagattaaaatgtcccggtaccccctcagtccacgaatttgcaataccgataatcggccgttccagatcatcactggtaaatcccattgatttataggttgcacggtagtactgattctcaattcctcttaatgttttttcacttctgaacattttatttcctcactttctttttgtatatatgataatttatgtatatatgataactcgtgaacgacggaaaatcaatagttgtttataaaaatgtcatttcgccaataattggcctctatttttgtatcaattgcacaaaaaaaacactttgagatttcctggaaatttcaaaatgttttttatttaaatcaaagaattattcactaatatcttttcaatgttatttttgcacttgattaatgcctgccggattgtctgcgctttttcttctgatttcctgaaaatcggaaatacgacgcttaaaccggcaacaatttctccattctgacaaatcgccgttccaatacaagcggtatgttcgccgctttccccttcttcataggaaaacccgctgctctttatggcttctatctgtctgttcaattcttccatatcagttacggtattagccgtgagggctttcagtccgtccgggtaaagcgtctttaattcagatgcttcatactttgacaaaatcgcttttcccaggcccgtggcatatgcaggcaggctgcctccaacctcagatacaacccggatggactcattcccctccacctttaacagatagaacacctcgccttcccgcaaaatccccatctgacaggtttcattgcattcctttgacagcttctccatttcttttctcaccagctccagagtggtactgccctttgaaaaggcaagtcctatatagtaggcctgcataccaatcttataacggttcccagtgggcgccatctccagaaagccttcttccagcaatgtctttaaaatgggtgagatagtacctgtcaatattcctgtttttctagtcaattcacttaacgtatacccttcctgactgttggaaagggcatttaaaatcgagatcacccgatatgtaggcatatgcatagatattatactctcctgtaaaataataaactgattatatcatcttttgttgtatgaaacaaggtttgagggttacttatggtaaggttccccactaataatccgataactccgatagatctgctccagcaaaacaactctcatcagctgatgtggaaacgtcatcttagaaaagctaagcctgtaatccgccctctttaaaacagcatcagaaagccccaaagacccgccgatcacaaaaacaatatggctcactcgtccgatcccaagcccgtttattttctccgaaagctgaatcgaatccagcatctccccatcaatggctaatgcgatcacataggccccgtccttaatcgaagaaaggatcctttccccttccttttccttaatcagtctctccacagcctcgctggccgagtccggcgtcttttcatcggccagctgtacaatatccagcttgcagtagcggctcagccttttgctgtattcccctatggcgtctgtataaaacttctcctttatttttcccacagttaccagagtgatcttcattggtatctcctttatgtgtccagttctttcttcatcatggcaatcagaagcttcaccatgtctcttgccggctttgtgtgctctgttttcaccttgcgcaccactttcccatctggtttcacattgatatgaaaaatgatccgcaaaaacgattccacctcatcccaggcttcccggctctctgggatcaagtccagtcccatctgaaatacatggaacatcccttcataaaccgagacccgccgcctcaccccggcctctttcagcttttccgccacagtcagagtatcgcttaaaagcacttcatagcttcctacctgcatgagaacagagggaaatccctcgtattccccgaatatgggagaaatgtaaggaatggccgggtcctgaccgccgatataatccgaattgtaaagcatattatccgtagaatttccaaagagcgggtcaatctcgtaattggacacatgactttccccgctgttggttaaatccgtccatgcggacatggtgataaatccaccgggaagggcgatcccatgatctttaagatacagccccagggccaggcctaacccgcctcctgcagaatctcctgccaccacaatatgctccggctggtatcctttttcctcaagaagccactcataagctgccaccgcatcctccaaagcagcaggataaggatgttccggggccacccggtaatctaatgtcaaaacgtccccgccgtagcttaacttggaataccggaccgcaaacctccggtaaatgttcttcatcggcccaatgtatccgcctccgtgaagctgtaagatcacccgccccgtcaccactcctaccgggcgtaaatactccattttcaaatgtcccagctcaatgatctcatattcatatcccgccggacaaacccaggcaggctccaccggattctttctcagttctccggtcctgataggctgtttcagcgaagtttccattacattctgcatcatatccctcaccagatttccccgtacactcacttttctacgactcatcagcagcgtcctccttttccggcatttttttaaacatgaaaccgtcttttcagttctgttttcacacttctatccccaagcacaatggtaacaaccagaataattactgttaccaccacggtaatcagggccagagacggccttgtaagaagaccggctccccacaatatcaaaggaataaagctgaacaccgtgacagcaatctggtacatgaaatagctctgccagttcatccggttcaccagaattaaaaagactatcgacaaatcagcaaacaaaatggtacttggaatcccgtaattcacggaccagccgttatagcccgtagaatggtccagagccactaaaagcacctgcgccgccactgtctgcaaaaggatctttgatgccagattggcatggcgcagaatggaatattcaaccgtaagagccgtataagccataagtccgatggcaatgacggaccataaggaaccggaataagtggcataattaatgacccccagaacagcccctacaaaaaacagcaatccgtaaaaaatggttaccagcttcttcagccgtttccggtcataccggatctgaggatacatgcccaaatcatcccggttatccgggacgccgttgctctccaagtttaccggaatccccagtcctcccagaaatccgaagaagcggtcctgaagtctggtgtcctgaaatacggaggtaaaggtcacgatcaccttttccccgtaagcacagaccgcacacttcaatggctgccttttggaaacgccgatcattatggaaaacctctcgatctctttcctgtaatcctcctctatttctattggaccgatattggaaagagtcatggtgtaggctttatcgtttttccggaaaaccaggtttaaggcacaccattttacaaaaagaggggcgatccgcagataccatttcttttcattggaaacattataggaaatgatttcctccatcttttccttagtgatctttaaagccatctggcggcttaccgcttccagcacctctgaaaaggtatgctcctcactggtggacaaaaaatcaatgagggtcacggcaaaaaaattggcggttgtttctgaggcgaaaaaggaccttaaattaatgggaatgctgatgccgatggatttctcacagggctttccccccagatattcctggtaaatcgcccagatcagtgctgccgtcagaaacctggtgatgctgaccccgtagcttttggaaaccgccttcagagcttttaagtccacataaccgtgaagaacgttttcctcgtcaaggggaagggtttcacctgtgatatgataggcctttctggaactgtatttgcgctttacggtctttttataatggcggacgtagctatcctccacgttcatggaaacatcggacgatattttctgaggagcctgatagcctgttctggaatcctgcttaagatccagataccggtaaaccagggcctttaaaaagttcacggctcccagtccgtctgtgaccgcatggaatacctccagattgatccgcctgctgaaataagtgacccggaacaaaaacagctggttgctgtgagggtcaatgtatttgcatgggtaggtcgtttcccgttcaatgacaggcatcctcttgttgttttcaaaatagtaccagaaaaatccccttctgagcctcaccgaaaatccttcaaactggggaaggatctcttccaaagcccgctgcagggtgcccggatccacctcttcttttaaaaccgctgagatccggaatacattgcttaaattctcgctggctatgaccggaaatatttttgccgtattgtcaagccgcctccaccgctctccctgtgggcttcgcttcatactgacagtgcctcacttccctttatccataaaatcaagacgcatatcataccagatggctcctccgtgcacagacccggacactcccatgttccggtatccgaatttttcgtaataaggaatcagcctgtccttgcaggtgaggatcattcctttccttcctcttttctttgcttcctctataaaacgcttcataagggcagcggcaactccccggccccgccactcttttatcacatcaagtccaaacacgctttgataagcaccatccggattatgaaaatccgttctttcaaacatttcgtcacagatagtatccccatctgtaacgctgccattaataaaaccgatgatctgcccaaaagaaagctctgccaccaggaagctttctggaaaacctttgatcctctgctcaagggcttcccgacctgccgcctcttccggcggaaagcagagagcctctacttctgccacacggtccaaatcctctgttttcacttttctgatattgtaatccattccattatttccccattttccaaattagcttaaaccatgtttttttctttcccggaatttaaagaaaaggcggatttccccggtctcccgtcagaaatcctcctctttcttttcctagacgcggaaataatatcccacgccccacttggtatgcacatatttaggatcgctgggactgggttcaatcttctcccgaaggcgtcttacatgaacgtctaccgtgcggacatcccccgtatccatagctttatttccccatacgtaagtaagaagctgttccctgctgtaaaccttacctggattgcaggtaagaagctccaaaagatcaaactcctttgccgtcaaattgatctccttctcagcaataaacactctcctgctgtcccggtccagctttaaatcgccttccgttatcacctggctgtcttcctggccctcccgcttattcttctttgaattccggcgcataatggccttgatcctggcttttacctcaaggatgttaaagggctttgtaatataatcgtcagcgccgtattccaggcccaggatcttatccatatcatttcccttggccgtcagcatgatgatgggcatctcggaaaattcccggatggcctgacatacctcgtatccgtcatatttggggagcatgacatccaaaagaaccacgtcatactctttctgctttgccagattaatggcttcctctccgtcataggcacaatccacatccatgccatcctgttccagactgaatctcattccttttacgatgagtttttcatcatcaactactaaaacgcttgccatactacacctctgtcttctatatttaaaccgttatgtcttcttttattttttgaaaagccgcatctttgatgccggatatcttcatgatatcctcgattttctgaaatccgccccggctctcccgatatttaagaatatcattggccttggcttctccgattccccgaagggtcatcagctcctctttggtggcggtatttaaattcactttctgtttttgcagattcgatgaagcctctgccggcagagaaatctctccgcgggcttttgcagcctctgcctcttccttattaaggaccacgattttcatgccatccgcgaccctctctgccatatttaaatattctgctgctgcctggtctgtgaatccgcccgctttctccactgcctgaaagacccggcttccttcctcaagctcataaacgccgggagaaaccacttctccgcagatatgtatgtagaaaggcagggccgttctgcctcctgcactttctaagacgctctctgccgcttctgatacttctgttccggttccgcctggaactggctgatcaccggaaaccggctgactatcgtctccggcttctcctgcctgaaaagcagatgcctccgataaggagatccctgacttttggtcttcccggcttctgccaaagccgtagcagatacctgcggctattatacacagggcaatcagagcgatttttattttctgatacttcatgatatccctcctcttacaaaatttcccaaaaaaggataccatcttcagcctatgttactattctacctaaagaaataggtaaatacaagcactatttccaaattaattaaatatcatgattccgatgatggcaaccacagcaccgatcagctttttccattcaaatcccactttttcaacgccgaataaaccgaacagctccacggcataggctacgatgatctgggatactacgataagcagagccgctttggcaggtcctaaggttcccatgctcttcactaccgtataggtgataaatgcgccgataacaccacccagcagcatgtatttgggctgcacatctaaaagtccggagatgccatccctgccggaaaaataccacaggatgagacaggtcaaaaatgccgtcagctgcacccagcctgttgatacccacatgctggtttgttttgtcacccctgtatttaaaactccctgaatgctcataagcgcacctgatatgagtgcaataataaagcctgtcataaaaacaacctccgtgtttccattttctttttactaggttgcactttatttgcatttttattctgattttactttttgatgcggcttgacaagcttatggatttgcgttatactcacagcgaaatcaaatatcgtatacacgctaggggagccttaggctgagatcggaataaaccgaaccctcactacttgaaccggataatgccggcgtaaggaagcatcattactcccctcctgcgcgcgcaaaggaggattttttatgtcattttttctaacttactctgctgaaaacgaagagtatttactacaaccggccggatacgggctgttaattattctgttggcggccatcctttttgccctgcaccttctgggtaaatccgcctcaaaatccaaggccatgcagacccgccagctggtttactgctcaggtgcaatggctcttgcaatggtaacttcttttattaaatttgcgtcccttcccttcggcggctccatcactctgttttccatgctgttcatctgcctgatcggctatgtttacgatgtaaaaacaggaattatgaccggcgtggcatacggaatcctgcagtttattacagagccctatatttttgccccgctccaggttcttcttgactatcccctggccttcggcgcccttgggctttccgggctgttcagcaataaaaaacacggtcttgtgaccgggtatgtggtgggtgtagcgggccgttacatatgccacgtcctttccggatatatattctttgcttcctatgctccggaaggcatgaaccccatggtctatactctgggctataatgccacctacatccttccggaactgatcctgaccgttgtgatcctgtatctccctcccgtgctgggagccatcgggcaggtgaagcggcaggctgttaatgggtaaggaaataaaacgtactcttttgtaaatcaaaaacaagcggtatggaaggatcggtaggcttccatgccgcttgtttcattattttattttataagtgcagccaataccagatgccttgccagcacagccgttgtcaccgttccaactcctcctggtaccggagttgccatggaagcagtcccttccagggaatcaaaatccacatccccgcaaagttttccgttttcgtccacattgattcccacatcaaccaccacggcatccgctcccacataagaggcatccaccattctggcgcgcccggctgctgccacaaggatctgggcatttttacaggtttcctttaagttttccgtgcgggtgtgacagatggtcaccgttgcattttccttaagcatcagcatggacagagggcgccccactaccatgcttcttcccacaatggccacccgctttccggtcagagggatatcactggactttaaaacctccaccactgcctccgccgtacatggggcaaatcccgtatcatcgcctgcaaatactttggcgatattttcaggagatatgccgtccaaatcctttccaggatcaatcatgtgctcaatgtctttttccctgatctgctttggcagagggcgcaaaagaaggatgccgtcaatatccggattttcattgatttttgcaaactcctccttaaatgcttcatcagttatatcctggggaaaggcaaaactttccccctgcaggctaaagctttccattttctttaaagctccccgttcataggataagtcgtctggccgttctcccacccgcacaatggcaagctttggagtttttccttttaagccggccaaaagtccttccacctgttctttgatttttgcagacacagctgcaccttttaaggttatcacgttttttctcctccttattctgcctttaatgcagattccacctttgcataaatggcgtcagcctttctggtcccgtcctctgccagcttatccgccctggcctgaagctgtccggccttttcccgctgcttcatggatcctgtattaatggaaacattcatctttgctcccaataaggcggaacggataaactgcacgccaacgcctacgtcactgacagccaggcggcttcccttttcagccagaacctccatgatatcaagggcttccagggcccgttccatgaccatgagagggaccaggctggcagccaggagatggttttccaggacttcagccttatgtcttttttcttcctctgtgccggttggaaggccgtatgcggcagccaaaggaacaaataccacttcatcttcatccgcaagccttaaaaattcgctttttaaagcttccagcttttcaagaaatgactgcatttcttcttccacgtcggcataccgctttttgccaagggttaagttcaccaccatttctcccaaagccgctcctattgcaccgccaagtcctgccgctccgccgccgcccggggtggggctttttgaagataatttttcaaggaatgtgtgaattgtaaagtcctgtatcataactattggtccgcctttccataccgcattttattttccattattatataagggtttccataaaaaaacaagtttaacttgtcaaggaaaacagtcaatgctatgattgtcaaaaatagtcaaatccccggttaatctctgtttttaaatgaaaaggagcatgaaatgaaatatcctcccttgacccttggctggtttttatatgaaacccccattgataatctggaattcatcggagaagatgaagctcttcataaaaccattaccggtatcagtgtactggataatcctgacggtgtaaaatggatcaaaaagaatgaaatcgttcttacaacgggttacatcttttataatgattttgaaatccagaaaaaaataattgcggatctccatgccattgactgtaccgctttctgcattaaggtcaaacgcttttttgacaggattcccgattccctgatcgaagaagccgccaagtatggacttgcgcttgtttcggtgcctttttatcacggttattccaatatcataaacgtaattaacgaaaatctcattgagcagaagattttaaaacagcaattcatcctcagagaagcagaaaaatttcatgaatccttttttaataaagaaggaattatgaaaatgctggagcggatatccaattataccaattccatggcaatgatcacaacaacatctgattttcccatatattaccgcattccgccaaaagaatacggggatttttccaggatagacaaattgcaggtccagccttccaattctctgcctgaagaaagacaaaaggagcacgccagaaaacgcaatttttactgcaatgacacactcctcacgtttcatgcctttctgcttcccgacaacaagcattacttatgcattgacatcacccaaaaagagatcgacgataccaccctggaagtccttaagcagatattctctgttcttgcgctggagctcacctccatgcagatccagaacagggccttttcccaaaaaaattattatgattcttttttctatatgcttacggatattaaaaacaagtccattgaggaaatacgtctggtctgcgacgcctattcctttcccattgacttaaaaaaggtatgcatcaccctggaatgccagtcaaaggaaagcaagctgttccgcagcctgtacaatgccgtaaaccagaggcttatccatttagcccataaatactttttatgccacagcgaaaaccacattgttatttttctcctgtatccgaaacaaacgcccaatgtggaagccctctcactggccaatcagattgccctgcagctgtcggattatttaaaggattaccaaacctttttcagactggggatcagccggtgccacacttcctgtgcctccattgcaaaggcatatgaagaaagcctgcagacattgcatctgcagacctctgaccgccaaactgcctccattcattcttataccaggcagtttgcatttcatcttttaaaccagctgacctcttatgaacgggaaaaaatataccaggatactgtcagcatcctggttatctatgattccgaaaataaaggggagcttcttgggacccttaaggcgtatttggaaaactccttaaatctcacggaaaccgcccagaagcttttcatccacaggaataccctgactgcccggctgtcctccatcaaaaagcttctgtgctgcgatatcacttccattgaggacattttccgcctgtatttgggaatctgcgcctgggagctgcttaaaaacacttaaagtctaggcatcgtcgtcgcattcattgcccgtgccaagggtttgaaagtgttccatatttccatacagatactggatccgctcaaattccgtttcatcgtagaagctgcattctccccggccgtaggcctttgcaacctccagcatgaatctggccgcctcttcacaatccgtgatatgggtggcaccggtcgcacagcctgccaccggcgcctctgtggttatggcaactccgatcacaggcgctttagtggcggttgccggctgaagaatgctgttcaaatgatacagcccgtttccataaggcgtgatatcctgctgggaaagggcgtatacataaggcaatttccctgttgtggtctgcatcagatccaaaatgctctcggaaacccgcagtatgtatccttcctttacggtaggagagacggcaaagcctctgttgttgatgatcctgtttccctttgtggtatcaacggataaaatggcatccagctcctctgtcacctcttcctgattcacctgcgccatattcaccggagaatccataaacggaaccggcttgtgctcccttgtgggtgcatccggacagatatgggtggatatgaaaacatccccgtccagacagtcccctttattctgcatatccagaagctttgctgccagggataaggcgataagggctccgtccccgtcggaaacaaaaccgatcctctccggtctggctcctaagcctcccagccttcccagcaagccgatagttggggcattaaagccctttccctttcctttcactccgggaatccttaccttgatcatatctgtttttcccttttgtccctccaaggtatacacctccacatcagcatccggcctgatggtttttaaatactcctttaccgtctttccgctggcatagctgctgtcaagtaagtcatgtacctctatcaattgcttcatcaacattgcgaatcctccaaaaatttatttttgcaaaagcagttttcagacacgcccttggcaactgcccgcaaggtgtttcactgaatttccataagatcacaaatagcccctatataggttttggcagccgtgatcacgtcctggatctggaccgtttcattataggaatgaattcccaccgtattggaaggcccgaactggatggtgggtatgcccagcatccggtaatctcttgcatcgcttgacgcccactggtaggcaggtatgacctcttttcccaataattcttccgcatttttcttaaatgccagaacaattggggcctcatggtcagtgaagttggcctcactcttataatgaagctcgtactccactccctctgctccgccggcctctatcacacggcctaaaacctcttcgatctcttccctgcggactccgattggcagccgcacatccacagttgcctcacaataatcgggaaccatattgtgcctggttcctccttttatctggcctatatttgtggtcacatgatcaatgacccttcctaatccgggaatgttgttttctttctccgcaagcatctgggagtcttttaagggtttttgctgcctgtccgtaaaatgtccctttatttccgtcagcatggaaacatggggcaacaccctggatagttttaaaatggcattctcccctttaaaattccccaggcttccatgagccgactttccaaaggcttttaaggtcagaagcaggcctcccttctgcccgatctcaatggtgttcatggaggttggctccgctaccagacaggcatcggcgtgatccgcatatccattggcacacagccactgagttccgaactggcctccgctttcttcatcggaaacaatgtgaagcctgatgttcccttttaagggaacgcgcttccttgccaaaagggaaagggcaaataagacaccggccacccctgctttcatatcagaggtccctctgcccaaaatctgggtttccgtgatctggccggaaaagggatcaaactcccactggcttaagtctccggcaggcaccacatccacatggccgttcatgatcatggaaaagcctgcctcacttccgatctctgccacaatacagggataatccggattgcaccctgtctcttgatatttgatcccggcttccttcagaaatgcttccacataattgatcacatccctttgggttccggtaggattttcgctttttatctgaatcagttcagataccagccttattaattcttctttatgttcatccacatattgcaaaagttcctttttcgtcatcccataatcctccgtttccggtttactctttttcgtataaaaagcaggctacctggtgtccttcttctccctgctgttttagctttggcatttcatttctacataagttcatgcaccggggacaccgtcctgccagggggcagcccttcctctccccaatagggcttggcacctctccctgaagcacgatcctctctttttcttcctcagggctttccgggggaatggccgacaaaagcgcctgagtatacggatgcagaggatttttatagatatcccctcccttgcagatttccacgatccgtcccaggtacatgatcacaattctgtcgctgacatattttacaacgcttaaatcatgggatatgaatacataggtaaggttgtattccttctgaagtttctttaaaagattgatcacctgggcctgtatggaaacatcaagggctgataccggctcatcacagatgatcaccctgggatttatggatatggcacgggccacattcagccgctgtctctgcccgccggaaaactcatggggataccggttcatgtgctgtacatccagtcccacctgctgaaacagttccaaaaccctttcttccagggccgctttacccttaacagtcttatgaaccaccattggctcggatacggaatcagccgccgtatgcctgggatccagagaggaataaggatcctggaaaatcatctgtatatttttgcacagcttcagcttatcctttgacttagcccctgctatgttctttccttcaaacagaatttctccttccgttggtttatgtagacccaccaggcatcttcccagggtggactttccgcatccggattctcctatgaccccgagcacctccccctcatggatttccagatcaatttcctgcagcgcatgtaaaaccgcatttttaccggccagcttctttccctttatctgaaaatccttggacaggctttttacctgtataatcatctttttctcactcatcccgtttcacacctccccgcaaaagacggctgccttgcctttgcctgtgacaggcaacgaaatgccccggttccagctcctttaggtccggcacctggtttctgcacaactcctctgcataaggacaccggttggaaaaattgcagcaggtccccgtcagccgtaaatccggcggcgttccctgaatcgttgccagctcttccccggaattgctgctcagctttggcatggaatccaacagtccccaggtgtaaggatggagaggattgttatgcaattccccgcaggcggtgtactcaacggtctttcccgcatacatcaccataacgctgtcacacatctgccatacaacgcccagattatgggtgatcagcaggatggccatcccgtttttctctctcatgccctttaacagctccagcacctgggcctgaacagtcacatcaagggccgtggtaggctcgtccgcaatgatcagctttggattgctgcacaaggacattgctatgattacccgctggcacatgcctcctgacaattcatagggataggaatccatccggcgcccggcatctggtattcccacctttcttaacgcttcttcccccatgcggtaagcctcctgtctgctcaccttatggtgggcgcagatcatttccgccatctgataacccactttaaataccggtgataaggaggtcatgggattttgaaagatcatggaaacgtcccgtccccgaaaggccagaagctccttttttcccagcttcaatacatccgtgccgtcaaagtctatgctgccgcttacaatctttccggttctggccggcaaaagccggatgagggaagaggaggcaacactttttcctgatcctgactctcccacaattcccatgatttctccccggtttatgcggaagctgactccatccaccgctttgctcacaccgcttgccgtataaaaatatgtttttaagtcatttaccgttaataatacatcacccacagcagcacctcctttactcatatcgttttttcatttccccaaagctttgtttcaccttttccatggctttgggagaagacagtaaatctgccgcagtaaaggccatggccttagctcccaccagcactgcccttttgcctgccatactgccgcaggcttcctcaaattcctttgtgtggccccttaattcgggaaccacctggatataggactggagcgcggggaggacatgggtgagattccccacatcagtacagccgatcccaaggtcttttctccttggcataaccgtctctccaagatccattaaatttttttcaagaagtttttccagctctctgttgttgcgtatgtcttcataggtgtacccatcccactcataccggaaccgggttcctgtcatggacccaaggagctgccctgcttccagaaactcctgcagtatggtttctttaaaccttttgtcaaaggacctgaccgtaaattttgcctggcagaaatcaggaatatggatgggatccctgcctccgtttgtaataacgcccagaatggttcccctgccgttccagcgcaggcgctgcccgcctatgtactggaataaatggagcagggggtccagggcactgtttccttcctccggccaggtggctccgtgagcgcctttgccgtagtattccacaatcagatctgtctttgaataggagatatcgttaactaccgtttcattggcagagtgaaggatcattgccgcatcaaggccctggaatgcttccttttccagcatgatgacctttcctcctcccccttcctccgccggggtgccgaacaccgagagctttcctcccagccggtggatgacagattttacgccgactccggctccaacggccatcgctgccatcaggttgtggccgcaggcatgtcccattccggggaccgcatcgtattcagccaggaagccgatatgaggtccgggctttccgctgtcatacactccctggaaagccgtatccaggccgcagattcctttttccacctcaaatccatagctctctaaaagctcccatatggctctgctggattttaattccttaaagttatactcaggattttcccaaaggtatctggcaagcttccacaattctttcccatgttcctcaatgctctgttctatctctttttttatcccatttatgtccatatgtattacctactttttcatttttggatccagcacatcccggattccgtctcccagaagattaaaaccgatcacagtgatcaagatgaatgtacctgatacggctgcaatatgaggagccgtatttaagcagtttctcccggaccgcagaatacttccccaggaggcggtaggcaattcaatgccaaggcccagaaagctcaaggccgcctctgaaataatggcgctggctatattgagcgtcccatacacgattacttctgaaaccgtgttgggcagaatgtggtgtgtcagcatacggaaatgagatatcccgatcactcttcctgcattgcagtattcttccttttttacaatcagtacctgtcctctcacgactctggcaaaccgtgggatctccgcaataccgatagccaggatcacattgatgacaccggaacccaggaccgtcataagaacaatggataagaggataaagggaaaggccagaactccatccatgattctcatcaggacggcatccacaattcctcccatataacctgcaataaggcccaggatcaccccggtcacaccgccgatgatggtggctccggctgcaaccagcagggacaccctggccccataacagattctggtaaataaatccctcccaaactcatcggtgcccaataaatggcctttttcaaaaaacttcagataggcatcaatgggatggatctcattgggctttccgtttgtgattaccggagccagcacggcaagggcgatcataaagctgacggcaaacaatcctaaaagggctgttttattcctctttagcttgctccaggcactgttggattttctttcttttcttaagatctcttcgtgggactgctgatccaatccaagtgttttcgccatttagaatcctccttcataattgacatttggattgatgatcatataaatcacatccacaaacatattgatcattacaaaggccagggctatgactaaaaccgcaccctggatcaaagtatagtccctgttgtcaatggcgcccacgatcagtgttcccatgcccggccaggaaaatatggtttccgtaaggatggcaccggcaaagcagccggccagctgtaagcccagcaccgttaccaggggcggcagggcacttttcaaggcatatttccagatcactacagactccttgatccctctggcccgcagcgcacggatagaatccccgtgaatggattccagaatgctggaacgggtgattctggaaaaagtggccgttgggatggttgcaaggcagaagcacggaagcaccatatggcggatcacatcacccagccctttggaaatatctcccatgccaagaaccggcagccagcctaaattcacgctgaacactaaaacaagcataagccccagccagaaaatcggcatggagacgcctaccagagccaggatcatgaacacataatcaaagagcgtcccctgatgcacggcagaggtaacccctatgagcagtcctgcgatcaaagcgatcaaaaccgcaggcagggcgatcagcagcgtacttggaatacgccttgcgatcaatgaaaacacaggctgattgtaggaataggatgttccgaaatccccttttacgatgtttatcatataatccttgtattgagctgccaaaggctggttaagccccatggtttcccgcattttctccacatcctccaccgaggcctgaggccccagaacagctctggcaggatcccccggtatcattctggtcagtacaaaggtcagcgtaacaaccacaaaaagagacgggatgatctgcaaacatctgattaaaattgtctttaacatatatctcctcctgtgtctttaaaatcagggatattgtgtaaatatttctattaaacctgaacccggcataaatcatttggcggcgaacacatctgccttacggaaatatgttctgtccgccaaatgatgaatggagcagctaaactgtaaccttacctggataaccagacattaatgtccgaagtacagatcttaaccttgccgtcagcgcgctgttctaagccctggacctttgggcttacgccccagtttacattttcatttgcatagaagatgccggggtactgctttacgataactgcaagcgccttcttatataattccgccctcttttcctggtcagtggtcagcagggcgtcatctaagtatttgtccacttcctggctgctgaagccctggccgtttccaagggaaccaatggagcttgtatggaatattttatttaaaaagaaatagggatccggataccatgtccaggacattgcaaatacatctgttttccccgatgctgcgatttcgctgaaggttccccattcgctggtattgatgttcacattaatatttaagttttcttttaagtaggcctggaataaggttgccatcttaaccctggcttctgtattggaaatgtaaatattcatgtcaaacccatcaggatatccggcttctgcaagaagcttctttgccccctcgggatcataagcaggaacttctgattccaggctggaatcgtatccccaggaacctggaggcagaggcagactggcaggctgtgcttcctggtactggtacacccctgcagtgagctcctcgatgttaacagccttgatgatggcttctctgacctttatatcagcagtcggaccgttgacctgattgaaataaatgtaagcaacgtgaaggcccggcatctctaaaagctttacggactgatcttctcttgctattttaacggcttccccgctaaggctggtggccagattgacctctcccgtacgaagggcgtttactgcctggtttccgtcactgaccggcttaaaggtgactccctccagataaggggttgctgcccagtatttctcattgcgtaccagaacagcctgctgatccagctcaaaggtctggagagcaaaggggcctgtgcctaccagatgggtaccaaaatcctctccccagccttctgcttcttcctttggcacaatcacattgcctgcatccgtcagtgctgttaggaaaacggcatttggttcggacaagtagcagaccacttccgtatcactgataacctcacagtgatccagcatatccagcctcttcatggcagaaagttcaagagaacgctccagagagtatttcacatcctctgccgtcatttttcttccatcctgatactttcccggctggaatgtaacatcatcgcgcagggtgaacgtgtaggcaagaccatcgtcgcttacggtccaggattttgccagggcaggctggatttccgtaaggtccgtattatattccacaagagtatcgcataccgtgccgatgatctgagattcataggttcccgtatacttgacaggatccaggtttttgggtgaagaagaaagggaaatggtcataacaccccctgagaccggctcccctgccggtgctgtcgtttcttccgctgttttctgagttgccgctgtcgtttccgccgttgtggccgaagaaccggaaccgcatgcgcttaaaccggctgtgacagctaccgtcaggattgctgctaacattctttttttcataatgattcctcttttcttgtatattaataaaacgacagtcaaagaaagcatagtcgcctttaactatcgttatattcgaaacatatgttattttcgtattccggttttcagatacaccctatgggtgctctctcagccacttgatggccgtattggcatatatggcagccattttgtgaaggctttcctcactaaaggtcactcttgagtcatggacgccgtaagggtatccctcttctgctgaaccggttcccacccacaaaagtacagatggtacgatctgggagatcacggagaaatcctcggagccggtcattctgggcagctccctgcaggttccctctcccagaaggccgtcgatatagctgacggaagcctccagaaggtccccgttattttccatgggcggaacgccctcatggaggaattccacctctgctttcccccggaacgcaccggctgtctgttctgcgatctgaaccagacgttctctggcaaagcttctcaccttttcattcatggtgcggatggttccttttaataccgctgtttcaggaaaaacgttggcagcggttcccccgtttatctggcagatgctgcataccagcatttcatcaggatttacctcccggctgtttaaggactgcagtgccatatggatgtgaactgcaatatgaatggggtcaatgcagagatgaggtgcggctccgtgtccgcctttcccttttaccgtaatggtaaaaatatcgctggaagcgcatgccgtattccgggaatacccaacggttcccgacttatcatggagtacgtggagagccattgccccatccacggaagggttctcaagaaccccagcctttaccatgtccgaagcgcctcccaccccttcctcacagggctggaacatgagctttaccgttccctttaattcctcttccctctccttcagtatccgggcggccagcagcaatgcgccggtgtgaatatcatggccgcaggcatgcataaagccgttttccgatgcaaaaggcagtcctgtttcctctttcatgggcagggcatccatgtcagctctcaataaaaatgtttttccgggctttccggccagcgccgtgatccctgcaattccgcaggcagaaggctcatagccaagggacttaagctcttccctcacaagctttaccgtctccggaaggtcaaaaccgatttccggttttctatgtatcagccgtctgatatggattccataatcctcaagttcctttgccctgaatagcaggtcattcatcccatcaatcctttcaattcctgttggcggatatttgataagtattttatcaaggagaattttttttgtaaataacagtttgcacggtttttcatacacaatttaagcatcatgcacagggatgaagccgtatttaaaaattcaccctgttttctcttttcatcagacgtctgtcaattcagaaacaaggcgggccaataaggttctgggaagaatgaccggctttccggtttcttttgcaaacagctgtttcatttcctggctgaacccaatgcagtccaaaaccaccagatctgcttttgtatcccttacaagactggctgcttcctccagctccttccattctccataaggggaacaggcggtaacggaaacctgctccacgatcctggaccatttttcctcactttgggttatttgcaaaggtgacggcgttaccacaagaatggaagaagctgcggtcagaagaggaacgactctgtctaaaatttcacaaggatagatgaggggtacttttgctttcagggtatccggaaattttcctgtacaaaacatcataataaaggcggttccctgctcttccagttcctggattgcctgctgaagtctgggaatgatatggcgttccgcaaaggtaacggaagttccgtcatttaacctggagaccagcacgtaatctccctcctttggggtgaattcctggatctgctctcttgtcaggccgtccagccctcccctttccaggatttccgccttcccgttaaaaatacccatgatatccgctgtaacgtctgttctcgggctctgcccgactgttatggcaccaatcttcatttttacttctcctctcatttcattaatacccattattgtacctactgccgggtccctatgtggataaattgatttttttgattttaacagggacatcctctgctgtcaacctcacatgaaaaaacacgcagccatggcccttctgaaacaggcatggctgcgtaccgcaaacactcaggctgatatttgcaggcctctttggtcaagccttttaggctgcggcgtcaaaactggtatgtataattttattcaaattggatatttaaaaaatgccagtttttctatatgatagagcataataaaacgatcagaaaatttttatgggaggaaaagatatgaacaacagcagaacaaaaaaaatcgtttacagtgccttgatggcagcccttaccaccgccgctactatggtcatacacataccatctgcattcagcggttatattcatttaggtgacgggatggtattgctcagcggcatgcttttaggaccgctggccggcggagccgcaggagggatcggctctatgatggcggacttactgtccggctacgccttttatgcgccggcaaccttgatcattaaagcattggctgcatgttcaggcggatatttgtacagacacttaccgtctaaaggacaggcgggcagctttcggccgctgccttttctgaccgccggaatagtatccagcgcagtagtcaccggcggctattttctatttgaactgctggtatatgactggcctgccgccgtttccaatgttccctttaatctggtgcagaatctcttcagcctgattgcagccggagctctccttcctgttcttctgcgtgtccgggagatccgggaactgagtggaaaatcggctttatagcagaaaaggaagccccggtggcttcctttttctctctaacctcaataactcctcataacctcgtctcttccgggaatcgaaggcgctgccccggctctggatactgcaatggaggccgcctttgccgcatgatccaaagcctgttccggagattctcccagcgaaagccctcctatgaaatagccggtaaaggtatctccggccccggtggtatcaaccacatgcacaggatagatcttctgctcaaacacctgctggccgtccttgtataaagaaccatcctggcccagagtcaaaaggacctttgccttgggaaatttttcagccagctgatccaaaagctctctgccgcttccgctcttttgacagatatccccggcttcaatctcgttcaatataaaaaactccacataaggaagaggatacgtccatattttgcggtccattggggaaggatttaaaataattctcatccctttcccatacgcctgttccataatgtatcccacttcattgatttcgttctgcagaatgagaaagtccccttctccaaattcacttaaaacttcatccacctgatctcttgttatttcctgattcgcgcctccatacaagagaatgccgttttggccttcctgattcttttgtatgatggcatggcctgtcttatttttcagcctcttaatatttcccgtatcaacaccgaactgctccagctcctggatcaggatcgcgccatcctgcgctcccaccgctcctgcatgccagaccttagccccgcttttgctcagcgccagagactgattcaagccttttcctccgcaaaatatctccagagaatcagaggaaatggtttctccctctctgacaaaatgatccacctggtaaacatagtcaatattcagagaaccaaaattcaatattttcatatcctgcactcctgtcccattcctacggtactgcttctaatcatcaatttcggttcaaataccgcaattttattttctgtttttttccctttgatctgggaaatgagccgttttacagactccacgcccatctcgtataccggctgtctgaccgttgtaaggggaactgccatcatctccgcatacaaaacatcatcatatcccactaccgatatatcttcaggcaccttcttatgatatttagacagctgcctgcacacgccaaaagcggaaagatcattacaggcaaataccgctgtaaatccatagtgcatcagcgctgccacagccctctccccgcattccatggtataatcgccttcataaatcagtttttcatcaaaaggaatatgaaattcctccagtgcacggacatagccttttaatcttctctcagaatccgccagattaacaggacctgttacgcaggcgatcctcttgtggccaagctctgctaaatgcctccctgccaaatatcctcccagttcatgatccaggattatttcagcacagtctgcatccgtaagaaaacggtccaggagcacaaacggcatctgcagctgttccaataagcggaccgattcctcaccggctgtctcatcgctttccctggacatgacatagatgatcccgtccacgccctggtcagccagaagatggatatactccatgtctctttcatggagatcgttggtattgcacaggatcagcgttctcccgtgctccctgcagcattcttcgatcccctttaccatatgggcataaaagacatttccaatgtcaggaataataaggcctatggttttgcttctctttttaaccagactgactgccagctgattgggccggtagttaagcttgcgcgccgattccattatgcgctttttcgtatcatccggtatcttataggctttcccgtttaataccagagagaccgttgtcacggaaagtcccgtgtcattggcaatatcctttattgttgctctcatcctcaatcctcgctgctgccaaatttgtcaatgcctgtattgcccttaaatacttctcgatctgcacacattcgttgggcttgtgtgccatatccgccgagcccggtccaaataagacagtggtaagcccttcttttccttccgccaatatggaagcatccgtaaaataggagatcccggaataagtttcccggatcccggcagcctccatgctttttaccagtctggaaactcctttggaagacttgtccgcctcaatgcttattctgtggttcttaatccggatgaccagacttggaatgcttccgtatttccggctgatttcccgaaataccgttttcagccggctgtgaatgctttcataagtaagtccaggcacggtccggatatccattaataccgtgcacagatcaggcgtcatattgggctgtattccgccctggatttccgtaatctgggcagtggcactccccagaaccggatggtcatgctcacggatccagctgcccagacgctctgccgtttcataggcgcagataactgcattgcagccttcttccggataggctccatggctggttttacctcttacctccagctccagccagatacagcctttctgggcgattccaacggtgcagccggtaggctctccgatcagcaaaacagacccttccatcatatggcctccggaaataacggctcttgccccggctcctccccgttcttcgtcacatgttccaagaaactggatggaattccccggctttttcccggtctcccccagctttcccagaacatataccatggcagccagtccgcttttcatatcactggccccccgtccgaagaggcagccgttttctatcaccggagtccatggttctgtatcccagctctccagttctccgtaatccacagtatccagatgaccgttccagatcatcccctctcccgtttcctctcccgggatcaatgcaatcacgtttcccctttcttctccaatatcctggacaaaagcctttattccacggctgcttaaatattggcagatatattccgcagcctgtttctctccgtctttcccgttgacggttctgatctccatcaaatccgttaaaagctgaattgcttcctgttcccagccttccttttccatttcaacccctctacttctctgtcagccagtcaaaaatccccttccaaagctggtcgtaatattcccactcacaaaattccggcggagcccagtgaggggcacaatccgtggtaaaggccgcacttcttccttttccgtaggttcccagcgcgaggaagggatcattttctatggtaacgggcaccattgcttccggctttgccactgttttgttgtatcccagcacctccggccagtctgaaggaagtccggatatggcatcatggctttctcttacaacaggctttgccccgtcacagtgttccattctgtcatcaacagttaaaacctccacaggaagaacttcctgaacagccgtgtcatgccattttccctttccatccacaccggaaaatgttaaatatcctccgatcatcaaaagagcacctccggccaggacataatccctgatcagtttacagcggtccggcatctttttgctgtgggtgaaggtcgccgcaggcaaaagcagggtattggctccgatatccgacaaaatgaccccgacatactgttttaattcttccatggtaaaaggaaactcttctgatgccaggtggttgggaagaaacgtcacctcataaccggcattttccagggccttttttaaccacttttctccggtctcataggaagaggtataaaaagaatcaaacccctttacatgtgtagtataactcatccaggattctcctgccaatagtattttcttattcatctgtcctgtcatcctttccccattctaaaatcaattgtgcatagatatgaatcgcctttaaatattcctcaaccgaaatatattcatttacggaatggcattgctccagatttccgggaccaaactgaatggtcggacatccggctatgttcttccacagcctggaatcacagccggccggtgaaccctttatgaccacgggtttcccctcagctgcttgaaacgctttttcaaagctgtctgtaagcagccctttttccatctcaaaaggtccgccggactgataaatactgatttccggcatatgctctctcagccataaatcgctttctgcaaaacgtctgatttcgtctgtgacctcagccaccacctgtttatggttcatctggccgggaaggtagtggatgcacatttcaaattcgcagtccccggccaccgtggatcccgcacttcctccatgaatggtccctacgtttaaattaggggaaggaagaagggggtgcttaaatttaagcagccagccatgctccagctcatcaagcctttctatgatcctcattgccttttcaatggcgcttacgcccagccatttggcaccggaatggttggattttccggttatctctactttcataaatacaaatcccatatgagccagaatcagttctcctgatgtgggttcacagactaccactccatctgccctttttcctctcatgaccgctaaaatggagccgttgccgcctccttcttcgtcacacaccgagcagatatggacaggaacaggaagagggataccggcatcctttaaaagctttacagccatgacggaagccataagcccccctttcatatccgctgctcccaggccataaagcctgccgccttcgatcctgggagaatggggaggcaccttccacaaggactcatcccccggaggcatggtatccatgtgtccgttaaacatcaggctcctgctcccctgtccgttaaaaacagcataaacattataccggtccttatagtcatggcccggattgccttctccaaatttctcaatggaggcagcgatcatctcttctgtcatgggatcccgctctatctcatccgctcccatttcctccaggagccggatcaaatattcctgtccttctttttctctgcccccggcgatcccatgtcccagatcctgggtatcgatggcgatcagctctgataaatatttaacgtattcttccctgtttctttccagcacttctcttaaatcttccatcattcacctcatgagccgtaagcccggattccctcctcgatcagatcccagaaacgttccacatcaatatctatggccacgtcaacattggcttctctgtgactgtagccaaagaagtcacaattggtcctgccatagctttgtacgctcctgatatccacttccgtatacatgggttttgtcaccagaagttccggatcaataatggaagcaatggtcaccgggtcatggagaggcccgccttcccacccaaaaacctctttctggctcttattgaaatgcgccatgagatccgcaaacagccgggcggccggattgcccgccgcttccatccgtttcacgatctggggataacagagcaccttcctggtcacatcaagtcccaccatggtaatggggctgccgctggtaaataccacatgggctgcatctgcatcggctatgatattaaactcagcagccggtgtcacattccccagctgatagcagcctcccatgaggacaattctttttatcttcggtatgatacggggctccattctcattgccatggcaatattggtcaaaggccccgtcggcaccaggatgatgtctccttccgattccatcaaggtgcggacgagaaagagtaccccatgctccgcctcttcccttctctttaagggttcaaaaacaggaccgtcaagtccggtttctccatggatatctcctgcaagaagctgcttatcccggatcatgggctgtccgcagccggcatagaccgggatatccagtcccaggtgctggcagacattcagggcatttcttatggttttttcaagggactggtttcctgccaccactgtaatgcccagcacttccaccccgctgtttcttcctgccaataatatgttcaccgcatcatcgtgtcccggatcacaatctaaaataaccttctgttgttccattcattcttctcctttcaggcttttgccaatgcgctcttttttttcttttcccttgctgccttagatgccatggaaactgcaagggttgctatggtcaccacataaggcattaagagcaccagctgggacggcactccataggcctgaagcctggctcctatggaatctgcaaatccgaacaccaggcacccggctgcagttaaaatggggtgggcgcctccgaaatacatggccgccactcccataaatcccctggcattggtcatattctccgtaaacattttgctgtatccaagggataaatgagcgcctgccagacctccgatcagtccggatacggcaatggcgcggtatttcatggaattcacattgatccctgccgtctgcgctgccatgggaaactggcctactgcccttaaccgaagcccccagaccgttttgtaaaacacaaaccagatcagaagtatcagtacaataacaaaccactcggttacacaccagttatcaaagatctccttgagaaatggaactttggccagaaaaggaaggctgaccctgggaatggcaatgattccaggctctgaaaacgtaccgctttttcccaaaacgctgtttaaaagaaacttggtaattgccagcgcaaataaattgattcccatgccaatagcgcagatctccgctttataacggatatggcctactgccatgatcattgccatgataagccctgcaatcatggcaaccgcaactcccagaacccagcttcctgttaaatagctgaccgctactgccgcaaatgctccggtgagcatgattccttctgttccgatatttaaaatatccgcctgctgggtaatggccgcgcacaatgccgcgtaaataataggcgtggcagaacgaaaggctgcatatatcaaagatacactgaaaattttgcttaaatccatacttctgcctcctcctatttgctcttttcttttttatgtttcttatccttaaactggaacaaaagctccatggttgccacgataataaaaactgccgttatggtatccacgatggatttcggtacgccggtgctctgctgcatccccatggctccggattttaacactgccaggaaaaatgacatgaagggagcaaagattaagttgttcttgacgatcagagaagccagcatgccattggagccaagtcctgccgcaaaattgtttaaaaagtatccgtgaactcccaaaacctcaatgcagccggccatcccgcccaatgctccgcttaccatcatggactgtataaaaatctttttcgggctgatgcccacgtactccgcatgagcaggatttgttcccaccgtttttaccttatacccaaaggtggtcttatttaaaacccagatcataagaaccacagtgaccagggcaatgaaaagtcctgcattgacactgctgggtttcataaactgaggcaaattcactgtcactggaagagactgggcattggctacccccgcactcatgggtccgctgaccagataggaggttatgtacagggccacactgttcatgagaatggtcacgcagacctcgctcacccggtaataagctttcagtacggcggggatcagggcccacaaggctgccgctgccattgcccccagaaaacaggctgccaggcgaagaggtgcaggaagaaacgtccagttgatcccgatgtaggcggctgccatgcctcccagaaacacctcgccttccactccaacattaaatgctcccgcctttgcagccaccgcaaacgcgcaggaggtgagaagaaggggcgtaaagctggccagggtggtgcctattttaagctttccgttaaatgctccccgcagcagggcaccataggcttctaagggattttccccgatagaaaggataaataaggctccgatcgccaatgcaagcagcatggtaagtaaaattttctgtatgctttttaccgttacattcatgttgtgccctccctttcctcagccggtgcagttccgcccatcatcagcaatcccaggttatcctcattggcctcctctgctttcagccttcctgtgatcctgccctcgtgcatgacaacgatccggtctgaaagggacaagatctcctccaaatctgcggaaaccagcaaaactcccattccttttgatttcacttcctgcaaaatccttctgatggattcaatggctccaatgtcaacccccctggtgggctgagaggcaaccagaagctttcccccaatggaaacttctcttgcaaccactaccttttgtgcatttccccctgacagggactgagtggatatctccggatccctgggacggatgtcaaaaacctctgacagtttcctggcatattccaggatatccttatcattttgcaccatccccttgcaaaacggagcttcgctcactttaacggctatgagattttccttgatgctcatggaccggtttaagccccttgtattgcggtcttccgggatatgagacagacctgcattccggatctgtctgggacttaagtcctttatttctttcccgtttaagagcacgcttcctttctcaacctgccgaagccctgtaattgcttcaatcagctcactctgcccgtttccgtcgattcccgctatccctacgatctctccttcccggacatccagtgataccccgcggatcttggaaatttccttttctccggaaacccatacatccttcacttccaaaaccttttcccccgggtttgcctgggctttttcaatatttaaaaacacttcccttccgatcatcatttttgcaagctctgccggggaagtctcttccttatttacgctccccacataatttccctgccgcatcacgctgatgcggtccgagatttccataacctcatttaatttatgagaaataaacaccagggattttccgtcttttttcaaattctgcaggatcacgaaaagctgtctagtctcctggggcgttaaaaccgccgtaggctcatccagaatgatcacattggctcccctggttaaggttttgatgatctccaccctctgcgcttctcccacggatatctgattgatctttttccccagctgtatatccattccatactggctgacatactgttccaccatctttctggccttgtcaaaatcaatggtgattccatggcggggctcaaatcccaaaataatattttccagcaccgtcagttcattgaccagcataaattcctgatgtaccattccgatgcctttttcaatggcagctttcggagtgatggatgggaattcctctccatggatccggatcactccgtcatcaatgggatacataccgtagagcagcttcatcatggtggattttccggccccattctctccgattaaggaatggatctcaccagtttttaaagtgaattgtccgttctttactgcatgaacatttccgaatgacttcacaatgtccttcatttcaatcacatagtcactcaaactttcaccctctttctcttgtcaggagtcttctcccgctccttttaaccggaaaatggtttggaaacccgaggggtctcaggaaatccaaaccattctccattcttttcagtttccgctatttgtttgcgccaaaaccggtataattctctaccacaatttctcctgaaacgatcttctcttccagttcttttactttttctacaatgtcttcggggaatttatctcccagatgttctttcatcacgctgaaatcggtcaggcctacgccttcttcctttatggtcagataagaagtggaatttcctttaaatgtaccttcaactactgactggatcgccagatagcaggctgtgtccacacgctttaccatggaagtcagcacacttcccggctggtcattatcctggtttaaatccacgccaatggcatattttcctgcttccttagcaccttccagaattccggggccagtgccggaggctacgttcattacgatgtccgcaccctgatcaaactgtgccaatgtcagctcttttccctttaacggatcattccatgttcctgcaaaggactgaagaacctggatttccgggtcaatatattttgcaccctgctcatatccaacgtagaaatcatgaaggaccggaatatccattccccctacccatccaatgatcttgtcctggtttaccccttcaatatctgttttctgggtaaacatggctgctgccgcacctgccaggaaagaaccctgattctgtgcaaagctgatggatacgatattatcaccttccaccgtggtatcaataatggcaaattttacatccggatagctggcgcaatgctctttcatgtactcttcaaagttcgaggatgagcagatgacaagatcataaccgtcctcgcaggcggacaaaaagtttgcttcccattcctctgcggatgtcccctccagatttttaatttccactccaaaatccgcggcagcctcttttgcaccctcattgcaggaatcattgtaggacttgtcccctaagtttccggaatacacaatacataccctttttccctcccctggcttttcctttgccgtcccattttccgatggggcctgtgtggtgggctctgctgttttcccgctctcctttgctgcacctgccccgccggaacagccggccagagacactgcaagcgctgccgtcatcaggatgctacaaaatctttttttcattgaaattcctccttataaaatataatataaaaggatttcatcttaccttcctctttggtaaaacgtttttccttttagttaaaaaataaaacagccaatgatctgcatttcttttaagcaaatgctaccatcctcagaatgagatgtcaagtatttttgcacaaaaaaatattttattaaaccattttccttaaataatttacctattgctttttattgttcattgacaaaattaaatatttgtcccataattaacggaatatcacgaattatttgttacaatcaataaatccagggggagaaggtcacatgacaattaaggaaatcgcccagttggccggtgtttctatatccaccgtatcaaaaatagtgaacaacaaagacaaaaacataggtcctgaaacaagaaaccgggttcttaaaattgtaaaagactatcattatactccatacagtacggttaaaaataacccggaagcaaaaacctttattttaggcctgctccttaaatccatggggaaaaccagccaattgattaacggcatcataaccgaagcacaaaaaagcggctacagtattttaatcaatgacagcctgaacagcccggaacatgaactgaaaaacatcacatccctttgcaaaaatcatgtggacggggtcatctgggaaccggtaaacggggacagcctggatcacaggcactatttcgaagaacagggcatagaagtctgctgtattaacagcaggaagtatcccctatcctattccattaattttacaggtatgggctatgctgcggcggaaattttggttcagcatggccatacaaagctgggctgcctcacaaaacagaacagcctgcgttctgaaatggttctggacgggtttaaaaagtgtttatttgttcacggcatcccctacagcagccccatggacctttctattgagtcggaagactggtacaatgccatattgacccacaccctaacgggaattgtcagcactcattatgcgtccgcccttatccttctggaacatttatcaaagcttaagttccatgttccatcggatttatccctgatcagcttaagagatgacgcccgtgaaaacattgcttttccaggcatttccagcctgcggatcccttactgtgaattcggggcttttgcctgcaggcgtatcatagaaaaatgtgagaaacgggaagaggaattttcagcctttcacgtggactttcccttggaaaatacccaaagccttggcctcccctttacctctcaaacgagaaaaatcgtggtggtgggaagcgtcaacattgatgtgaccttaaacgtggatgaacttccccagcccggacggaccgtcagcaccagcaggcattccgtcattccgggaggaaaaggcgccaatcaggccgtaggtgctgcaaaacttggaaatgaagtttctctcatcggcaaggtgggaagcgattacgactccaacatcatatacacctgtatggaagaaaaccaggtggatgtccaggggttaaaaagggatgccaacagggaaacaggaaaagcctatatccatgtccagaatgacggcgaaagcatgattaccatactgacaggggccaaccagaatttatatcctgaggacattattgcttatgaaaaagtctttgaacattccggttactgccttcttcagaccgaagtccctgaagctgctatagaaacagccgccaggctggcaaaaaaatatggtgcaaaaaacattttaaagcctgctgccatgaaatccatccgcccttcccttatgaagctcattgatatatttgttcccaaccacaaggaagcggagctgttgtgcccggatattcccggtatagaaggaaaagccgctgaatttataagacagggagcggaaaccgtgatcatcaccctggggcattccggctgctatttaaaagccccctcctttcagggatatctgcctgcctctccctttccacctgtggatactaccggagcagcagatgcttttattgcagcactttccgcatatttatcatcaggatattctatggaagcatcggccagaatcgccgcatatgctgcaggcttttgcgtatccagacagggggtaattcccgccctcattgacagaaattccctggaaacttatattaacagggttgagccggaactgctgaaggggtgaagacaaaacagctcttctcctatcacagaatacaggattgatcactttgccaacccaatcattacacaaaaaaaccggagccttcagatatccttctgaagaccccggcaaaaggtttaaagctgatgcttcagtacttcctccagcttttctatcatttcatccacatgttctttttcgatcaccaaaggaggaacaaagcggatgacatttgttcctgcgctgataagcaccagcttttgctctgacaaggcctggctcacaatgggggcagccggcacagaaaactcaaggccccggatcagcccaatgcctctttgttctgttatgatttcataccgttctgccagagaattaagcttctttgcaagatactctcccatttcctttacatgatccacgatctttcgcttttcaaacagttccagcaccttaaacgcagcagccgtcacaaaaggatttccgccgtaggtggtaccatgatcgccgggagtcatggctgttgcggcctttcctgctgccagaaatgctcccacaggcacgccgtttcccagggcctttgcaacggtcatcacatcaggctttacgccgtatttctgccaagcaaacatggttccggtccgccccattccgcattggatctcatcaaggatcagcaccatgtcatgttcatcgcaaagggctctcacaccctttaaaaattcttcactggccggataaatgccgccttctccctggaccgtttccatgattatggcgcaggtcttatgattgaccagggcctttacgctgtccagatcattaaaatcagcaaatttaattcctggaagcaaaggcttaaatggctcctggtaatggtcatttcccgttacggaaagagcgccaaaactcctgccgtgaaaggagtggttcatggcgattatttcatggtcatgacccccgtccttattataggcgtatcttctggctatctttaaagcgccttccaccgcttctgtcccgctgttggtaaaaaacaccttatccatgccggatgcctttaaaatcagctctcccgcttctacggcagggacattgtaaaagaggtttgaggtgtgaagaagcttatccacctgctcctttaaggcctcattaaattccgggtcattgtagcccaatcccatcaccgcgatcccggcgccgaaatctaagtattcctgtccgtccgtatcataaagatgaatgccgtccccgtggtcgaaaacaacaggaaaacggttataggtcttataaatctcagactctgctttctcaatatattcctgtttacttagcatgataaaaacgctcctctcccggacttataatggctgttccgattcctttattggtaaatatctctaaaagcagacaatggggaatccgcccgtccatgatatgtaccctggataccccctgtttcatggcgtcaatacagttttgaagctttgggagcattcctcctcccagcatcccgctttccacaaattcctccgcttcgtcgatggacatttcggaaatcagagattccttatcctgaaaatccttataaactccttccacatcagtcaaaaaggccagtttctccgcctccatggccgtggcaatggcgcaggccgcatcgtcggcgttaatattataggtctcaaaatcctcgtcaaaacccacagggcagatgattgggaggaaatccttttccagtaaatcatatatgatctgagggtccacctgggtgatatctcctacaaagccgatgtcctctccgtttgaatagcgcttttggcactttaacatcatgccgtcttttccgctgattcctactgcttttacgcctaattcattgaccatctgcaccaggcttttattgacacggtttaataccatttcagcaatctccatagtgggctcatcagtcacccggagtccattgacaaaatgcggctccatgcctgacttttccacccacttgctgatttcctttcctcctccatggacgatgatgggcttaaagccaaccagctttaagagcaccacatcctgaataacactctttttcagctcctcatccgccatggcactgccgccgtattttaccacaatgatctttctgttgaaacgctgtatatagggaagggcctctatcagcacctccgctttttccataatgctgtgatccagatccatagtaatttctcctttcctgcccatgttttccgggcaaatcccaccccgttttagagcctgccccgccttctcgggcatcggatgtacaggtattccaaattgattttatgagcggtaatccgcattaatcttcacataatcaaaggtcagatcacatccccaggcagttgcagctgcttcccccatcttcacatcagcaattgcggtcacttccggctctgataagatctttgtggcttcttcttcgctgtagggaagagcaaccccgttttcaatgattttcagttttcctgctgcgctttcgaaatataaatccacctgttccgggtcaaacattgccccggaatatcccatggcacaaaggatccgtccccagttggcatcgtggccgaaaatagcggcctttgtcaggctggaggtgatgacggatttagaaagggtcacagcctgttcctttgtctccgctccgatgatctttacctcaaacaacgcggtacagccttccccgtcacctgccattttctttgcaagagtttcattaacgaagttcagggctttacagaatgccttataatcctcattttttgatgtgatctcctcattccccgccattccgtttgcaaggagaagcaccgtatcattcgtagaggtatctccatccacggaaatcatgttgtaggtgtccttaatgtcctgccttaaagcttcctgcaaaagctctttggaaatggccgcatctgttgtaacaaagcttaacatggtgcacatgtcaggatggatcataccggaacctttgcacatgccgcccatggtaattgtctttccgcccatctcaaactggaccgcagcttcctttttcaccgtgtcagtagtcataatagccatggctgcgcctgttccgctttccaggctgccgtcaagagccggtacaagagcctttaccccggcggtaatacggtccatgggaagctgcttgccgatcactccggtagatgccaccagtacggaattaacgggaatggaaaggctttccgcagccgcttttgccgtttccttacaatagcgaagcccttcctctcctgtacaggcattggcgattcccgcattgataaccactgcctgggcgtaaggggaatttgttacaacatccttatcccactttacaggggccgcttttacaatattggtggtaaaggttcccgccgccttgcagggagcctcactgtaaatcattgccatgtcttttctgtctttatatttaattcctgccgccgcagatgccgccttaaatccctttgctgccgttacaccgccgtctgtctgcttcatatcattcatcctcctttgttccaatgaccgtatagcctgcggtctccaaatgctccaaagccttttcgtaattttcctttttcacgagaatatagtccgtattaaacgtagatagcgcgaagattccgattccgtgatctgccagtaccgttgatatcttcgataagatcccgatgagggaaaaatccaggaccccctcaatgcaaaatgccaaaaaaccgtcctcctgctcttccacatcttcagggactgattgggattcacataccagagataactcctggtctgtttttcccagaaaccagaatccggatgtcatgtcaagctttcccaaatccgctgatcctgatagcttgcatacggaaaattctgctgatatcctctttaaattcatctctttcctcccccttaatcaataaaatttgtaatgttagccccatttaaatcaaaatcataataattcaaatcatcgcgaaaggtccagcctactttattccagaattcgttgccaacggcattggatttaaaagcgatcaggctgaccttattgattccttcttctttcagccttttcattgcttccagagccatcttttggcctattccatgcttccggtatccctctgccacgcacacgtggtacatgcagccccgccgcccgtcatggccgcagagaatggagccgatgatctttccatcttcttctgccaccacgctggttgccggatttctatttaaaaacatttttacaccttccctggaatcgtccacagttcgcagcccaaaacctttaatcccagaccagagttcataaaccttgtcataatcctttaatgtcatcgtacgaatcatcataatattttcctttatttaagcattcatttgtaagccttacgggaacatgggaatcagcttaagccccttgttctccggcagtccaaacaggatattcatattttgcaccgcctgtcccgctgccccctttaccaggttatccatggagcccatcatgaccacccggttcgtccttggatcgatcttaaagtttacatccacaaaattgcttccttccacccacttggtctggggaaccacatccttttccagcaccctgacaaaatactcattttcataatacttatcataaactgccttcacttcctcataggaaacagatctggcaagagttccataggcagttatgagaatgccacggttcattggcaccagatggggagtaaagctgatggtaacaggacgtcctgccccatatgacagctgttcctcaatttcaggcgtgtggcggtgaacgcctacaccgtaagccttgatattctcattgacctcgcagtataagttatcaaccttggctcctcttcctgcacctgatgtcccggacttggcgtcaatgatgatggtaccgggatcaatcagcccttcctttactaagggataaatggataaagtggagcaggtaggataacagcctggattggcgataagcctggcatttttgatcttttcccggttgatttccggaagaccataaaccgcttcctttataaactgggggtcttgtgctccattttataccattcttcatagattgccacatccttgatccggtaatcggcgcttaagtcaatgacctttgttttctttaatatattctcattcataagggaagcgcaataaccctggggcgttgccgtaaaaatcacatctgccatttctgccaaggcttccatattatcatccaggcaggaatcatcaacgatctgaaacatgttttgataaatagaagcgtatttttgatccacatagcttttggatccgtaccacaggatctccacatcatctctctgaagcaaaagccttgcaagctcgccgcctgcatatccggttgatcctattattccagccttaatcataatcatctctccttttattcttcatgagtaatctatttttatttctgcagtatccccagtcgtttgctgccgtgtatctgactctgccggattccggcattttatgcattgatgctgtcggctcctttgaaaaaaagagcgtctttccatatatttcatttactgatagttcataattatacatccacaacgcataatatgcaagttttttttatattttttcattttacccttgcattattcaggattttggtgtatatttatgaaagtccaatgaaagaaaatccaattataactgaggaggatgtataaatgaaagaaaaagttattttagcctattccggcggccttgataccactgccattatcccgtggttaaaggaaaattttgattatgatgtcgtctgctgctgcatcgactgcggccagggaaatgaattagacggtttggaggaaagagccaaattatccggcgcttccaaattatatattgaagatctggtcgacgacttctgtgacaattacatcgtaccatgtgttctggcaaatgcagtttatgaaaacaagtacttattaggtacctccatggcccgtccggccattgcaaaaaggctggtggagatcgcaagaaaagaaggcgcaaccgccatctgccacggtgctaccggaaagggcaacgaccagatccgttttgaactgggcatcaaggctcttgccccagacttaaagatcattgctccatggcgtatgactgacgtatggaccatgcagtcccgtgaagacgagatcgaatactgcaagcagcatggaattgaccttcccttctccgctgacaacagctacagccgtgaccgtaacttatggcacatcagccatgaaggcctggagctggaagatccggcaaacgagccaaactatgaccatttattagtattaggcgtatctcctgaaaaagctcctgatgaaggggaatacgtgaccatggcttttgaaaagggcattccgaccagcgtaaacggcgaaaagatgaaggtttctgatatcatcaccaagctaaacgaactgggcggcaaacacggaatcggcattgtggatatcgtggagaaccgtgttgttggaatgaaatcccgcggcgtttatgagactccaggcggaaccatcctccttgaagctcatcagcagttagaggaactggtattagaccgtgctaccatggaagtaaaaaaagatatgggcaacaagtttgcacagatcgtttacgaaggaaaatggttcactcccctgcgcgaggcagttcaggcttttgtggaatccacacagaagtatgtgaccggagaagtgaaactgaagctttataagggaaatatcattaaggcaggaaccacctcaccatactccttatacagcgagtcccttgcttcctttacaactggtgacttatacgaccaccacgatgcagacggcttcatcaccctgttcggacttcccttaaaggttagggctatgaagatgcaggaagttgaaaaaacaaataaataattaagcaaaaaggacgtacacaagggtattttccccggtacgtccttttttataactgtgataaaggcatactgtcattagtctgccagctcctttaaagtatcaccggctatgcggtaaaccgtccagtcctccattggttccgctcccatggaacggtagaaatcaatgctgggtttgttccagtccaggcaccaccattccagccttccgcagccacgttctgctgcaactgctcccagcttctttaataacgcctttccgattccacagcctctgtactccggtttaacatacagatcttccagatagattccggctttccctaaaaatgtggagaaattatgaaaaaacagtgcaaatccggcctccttcccatcagccagggcaaaaatcacctcagctttttgcttgttaaagatccattcttccagcagttcttccgttgccaccacctcatcaagcatcttttcgtattcagccagttcttttatgaatctcaagataagagccctatcctttctctcggcatatctgaatgtcaattccattttctttcctcctaaacgtgtctgcctgtttcataacccaccaggtgctgtccaataattggttattaattttaatatatcacttctctatgtctttttaaagcaaaattggggattgaatgggttgctgaccaactttagatattaaatcctgaccgctatattaagataaaaaatgccgccatgcaacctcaggttgcgtaaacgttctgaaaagaacgctggaattggtagaaaaaattctattttccaggtatcatgaatttatcaaatgaacaggagaaaccatatgagctttggacaaaacttacagtttttaagaaaaatgcataatggaatgacgcaggaagaattggctgaacgaatgggggtaagcaggcagactatttccaaatgggagctggatggtgcttatcctgaaataaataaagcgattgagctatgccagtttttttcatgctccatggatcagctgatcagggaaaatatgaatgtgagcaacgaagcatactctgatacccgcattgaggatgttccggcattacggtatatcagatacgcagtcatcagcagagagccggaagatgatgcaatcaggcatgtaagggattgggctgcagatttgggaatccgggatccggaaatcataggctggacttccccatagtatcccaggaacagatcaatgtgcatcatatgcacgggtatgccgccgcatgtattttatcatcaggcgtggaatgcaatgacagtcttgccgaagtgattttacaaaaaaagcaccgttatgccgtgattaccataaaggaacccatgaaatcacctttccggttaattcccaatgcctataaaacattgatggcttacattcaggtaaacggactggaatggaatgataaagactgtctgccgtgttttgaaaaagaatatggaaaagagggaatccactacatggatgtgtatatggcggttgattgaagaaacctttcagctctcttttacaggaatgtaaggaaacgccgataaccggataaacctggtatctatcccagttcccggcgtttcatgttcatacctaagttatattttcagtcccgtctttcactcctgaaacctattttgttcctggtaaccctatcttttttccagtacacgcctgatccggggcatcatcttttttgtatacacatagccgttttccatacacttttccatgcattcaaaagtcagaagccctgctcctcttggcataggcggctttaagagcaaaatctcaccgctggaacgacagtcctttaactctctgctcataatggaaaaggaatggaatgcagtttcaatgatggaataatcatggggcatctcatattcttctccaatgtccactgcaatgactctggtttcccctgccgaaatgaaaagatccacaggaaggttgttggtcactcctccatccaccagaagaaaaccgttcatctgccttggctggaacacggccgggaccgaagagcttgccatcataatatcacagagaagtccgctccgttcccatttcacatgctcctgccttaatgcggaaaggggaatctcttccctgaataagttagtaaaggtgaccgtatccccgctgtttatatccacagccggaatcagcagcccccggcagtttccctgtatctccatcccatctgttaaatcacagaggaatcgctggagcctgtttccttttatgagccctttcagcgctgtctccctgcccagcagaatctgaggcagaaataaggcaattcctaaaatatcgggatcaatcaggcttctgccatgtttggaaagccaccgcacagtttcccgcatatctccggtgttcatgcctgccgcatatagtccggcaacaatgcttccggcgctggctcctgctatccgttggggaagaagtcctgcttcctccagcgccgtcaatactcccacatgagccgcgcctctggtcccgccgcctgctaacgccagtccgtagtccgccatgaatcattctccttgattttcagccgcatttcaggaaaatgtatgccctttcttcttcatttatgcctggccaggcaaatacaaaaaagaacagcctctttgaaccatatccctttctaaaggaaggccgacccaaaacagctgttcttttcttatataatcttatttataatatgcatcaattccgtcggcaatcccttttgcgatcttgtcccggtattcttcggttgccatcttcttatcttcttctgcattgctcatgaatcccatttccacgatggtcaccggtatattgcaccagttgatgccgctcatggaatccgtttcctgaaccccccggttcttaaacccggtctggctgcagatcccgtttacaacagcttgggaaagagagagacttttactgtataggtttccattataaggatttttagaggtctggcacatggtaagcgccccctggatactgctgtcatttaaggagttggcatgaacccggatgaatatgtccgctccgcttttatccgccatctgggcccgttctgcattgctgatgttcacatcatgggtttcccggatcatatagacctgataccctctgttgataagctcctgctttaactttaaggaaactgcaagggtcagctggtattccggaatgccggttgccgttccctgggttccggaagccacttttgccttcatttcagaagcgccaggcccaatgggttccttttcggaattgccctttgcctgatggcctgcatcaatggcaatgagcttgccagttccgtttccggaaacagcaggcgcggcagccgttgtctcctgtaccggcttatcctttgacacgtactgagaggaaatatagcactccttatcctggtaaatcacccggctccagctgtcactgtatccggttctttttaaggaaactcctttttcaagctttcctaggatctctccctgggcagaaggagattttcttaaattcacctgggagccggtaacgtaaaccgtctcatcggctgccgcaaaggtcggagcagtctccatcgtcaccgcagcttcatgggaacttgtctccgccggctttccgtcgggagcctccccggttttgtcctctgcaatggatacaggggcggtttcctccccttcctcctggcccagaccaccctgggcttcttccagggcaggcacttttaccgtttcatatttcctggcacagcctgccagcacaaatgcacaaagaaggactgaggccaataacagccacccattttgttttcttaaattcgtcacagtatggttcctcctccgacaacataatctccatcataaaataccacagcctgtccaggagtgatagcccgctggggttcatcaaacctgcattccaccgcaccatcctctgcttcccgtatggtgcacatggctcccttatggctgtagcggatctttgcagaaaccctcatgctttctccttgaagaccggagacagccatccagttgatgtgattggcccgcagagtatcagaatacacgtcatcgcctgtcccgatcaccacttcatttgtctcgggccgtatctccactacgaagaccggtctgcccatggacagattcagtccctttctctggccaacagtataatgggtgattcccttatgccgtccaatgacctgaccggaaaggtccacaaagttcccctccggcgctttttcccctgcgttctcttcaataaatcccgcataatcattatcaggaataaagcagatctcctggctgtccggcttatgggcaaccattaagttgatcctgtccgcgatctcacggatctggtccttggaataggctcccaccggcatcagggtatgggacaactgattctgtgttaaattgtaaagggcatacgtctggtcctttgccgctgtcacggatttctttaacgcatatcttccattggggagcttaccgatctgggcataatggcctgttgcaatataatctgctcctatatccaggctgcgctttaaaagtgactcccacttgacataacggttgcaggcaatgcacggattgggcgtgcgccccttctggtattctcctacaaaataatcaatgacctgggatttgaattcttctttaaagttcatgacatagtaaggaatcccaaggtcccaggccacccgcctggcatcgtccacggcacttaacccgcagcagcctccgttttcttcctgggtcccggtatcctcatcctgccatatctgcatggtgacgcctatgacgtcatagccttgttccttaagcagccacgccgccacagaagaatccacgcctcccgacattcctactactactttcgctttactcatagactcacatttccactttccagcccacgctttttgggcatgaaggtatacccgcaagggtgtttccactttccagcccacgctttttgggcataaaggtatacccgcaagggtgtttccattctttcttccgggtaagcaaaagcccggaattctaatattcttctaccacttcttcctcgccgatatcagactttggtttcttcaagccatcaatctcgattccgtttttctttgcatagtcccacagagcagcgtggatggcttcctctgccagaagtgaacagtgcacctttacaggcggtaatccgtcaagtgcctcacagacagcctgattggtcacagccattgcctcctgaacggactttccctttaccatctcggtagccatgctgctggttgcaactgcggctccgcagccaaaggttttaaatttcacatcacggatgatctgattttcatctatatccagataaattctcataatatcgccgcacttggcatttcctacggtacccataccgctggggttatcaatttcccccacatttcttggatgctcaaaatgatccattactttttctgtatacataatctattttctccatttctaggtaatactcccactttgttgccggccgccgtcagcggtgcttcggattatttcctctgatgcttgatataatcctcataaagcggggacatgctgcgcagtttttccacgatttctttaatggattccacaacatagtccatctcttcctttgtattttcttcatctaaagtcagacgaagagatccatgagcgatctcatgaggcagtccaatggcaagaagcacatgggatggatccagggagcctgaagtacaggcagaaccgctggagccgcagatgcccttcatatccagcatgatgagcagagattctccctcaatgaactggaacgcaaaattcgcattgttggacagcctgtttttcctgtgcccgttaattcttgtataaggaacctccgccatgacccggtccatgagataattacgaagctcacattcctttttcgctctctcttccatgcctgccaccgcaagctccacagcctttccaaagcctacgattcccggcacattctccgtaccggcacggcgttttctttcctgtccgcctccgtgaatgaaggaacgggatttgatgccgcttctgatatagaggaagccaatgcccttgggaccgttgatcttatggccgctggcactgagcatatcgatatgataatcatccacattgatgggcacatggccaaatgactggaccgcatccgtgtggaacagtattccgtgttcttttgctatttctccgatttccctgaccggttctatggttcctatttcattattggcaaacatgatggaaatgaggatggtatcaggacggatggcttttttaagctcttccagttttatgaccccattttcatccacatttaaataggtcacctcaaagccctgcttctccaaatactcacaggtgtgaagcacagcgtggtgttcgattttgctggtgataatgtgttttccttttgaagcataagcctccgcagttgcaatcagtgcccagttgtcggcttctgaaccgcctgctgtaaaatagatctcgttggtcttggcgcccagagcgtttgcaatggtctctctggctcctgccacggccttctttgagatgccggaaaactcgtatacggaggagggatttccataatactccgtaaaataaggcagcatggcttccacgacctctggccgggttttggtagtcgctgcattgtcaagataaatcagctgtttcatattgttagttccgcctttctgtagtcctaaagttaaaagcttcatctacaattattattatacacacatttcctagaatttcaataggaatgattctcattatgaatatgtcatgaagaagaagcccattccatatattataataattctctttttcaggagattccatgaatgactctctgaaatttccccaaaaactttcgccaagaaaatatgcgcttctcaccggtacccttctattgacttctgccggactggttacccggctcctgggctttgtttaccggatttttctctcacggaccattggcgcagaaggacttggaatctttaacttgatccatccggtgttcggcatctgctttgccctgtgcgccggttctattcagaccgcaatatcccagtccgtggcagctaatgtgagaaaaggccgttccattttccgaaccggcctcgttatatcagtggcaatttccataatcctggcatatgccatcattcggtttaaggacttcctggcagccaatgtcctgatggaaccccgctgcgctccccttcttctctttctcgcagtatccgttccctgttcggccattcacgcctgcatcaatggatattattatggtatgcagcggccccatgtcccggcatttgcccaggtgatcgaacagacaataagaatcggagccgtattcctcattgcagatatcatgatcgaatccgggatcaaaatcaccgtccagcttgcagtcatgggccatctcataggggaaattgcttcatctctttttactgttatggcataccgtttcttttcgcccaaaatgcccccaggcattacattggtttcttcttcctttcgggataccgctcccgggcttatgcaactggccctgcctcttatggggaaccgcctggttttaaacatccttgcaagcgcggaagccattttaattccaagcagactgcagatgtccggactttccgattcagcagcattttccgtatacggcgtattaacaggaatggccctgccctttattctgttcccttccaccatatttaattccctggcagtgcttttacttccaacggtggccgaggcccagtcagagggaaatgagcggaggatcggagatgccatttccatgtcactgcgttactgtctgtacgtaggaatcctctgcatcggcatattcaccctgttcggagatgacttaggcgtcagcgtatttaaggacaatactgccggaacctatatgaccattttggcctggctttgccccttcatctatctggtaaccaccatgggaagcattttaaacggccttggaaaaacctcagtcacatttatccagaatgccatcgctttgctgatccgtctgggatttgtcctttttgggatccccaggttcgggatcttagcctatttggtgggaaccctggccagcgagctgcttctggccatgatgcatgtgctgacccttcggaagaaggtggactttgtttggaacgcatgggatatgatcgtaaaaccggcagctctcatggtgctcgccattgggatttactttgcggtattttccctggcagatccgttccaggggatgtctttattcataaaaacggctttccatatcgctatattaagcatattctatctggtgcttcttcttggcgcccatatcatgaaaggagagaaaaccggggatcactgaattatttccgacaggtgaatttttatggtctacataatgaaagtaaaaaacggactgttgtaagtccgttttttataaatcctcttttagtcgattccaaccattacagaagtggctttaatgatggcatatgcatcctttcccacttccagctttaagtcctttaccgctgccatggaaaccgtagcagaaacgatgttgcctccgccgatgtcaatggttacgatagcgtttaccgcgccagtttcaattcctataacttttcctttaaactggtttcttgcgctgagcttcatctgatatgtctcctctcatccaaacctgcctttagaaacacccttttggcatacctttacgcccgatgcccgataaagcgggcggcccctgccaaaaaggcacggacaggaaagtggaaatatctagcagtaattatggattataaaccggaagattatactgctttttataaatttattgtaaacatttcctttttcattgtcaaccaattcctggaaatacaaaaaactataataaaagcaggagatcttcctttgggaaccggataaatgaaggaatgttctgaacggctccttcttcaaaatcaattttatcctgaatccaccagatctttatagaggtcttatcatttatgttcctcagcaggtactgcctttgaaagggagtatcggcaaacccggccaattcaatgcccatggcattttcctcttccggtcctaaggcagggatcaggttatgtccccggattcctacataccggacagagtctccgattttctcctctgtcttaagcctgatcttccagtcgcaggcaaaaagctcataatcactgattttttctatggaggaaatattcttgcagccggtcagctttgctgcctccattctttccggccttcggaaaatgtcctttgtacagccttttaatatagtatttccctctgaaaggaggatcatgcggtcacaaaatttatagatctcatctctggaatgggataccataagcacatcaccggtatagtccctgatcacttccagcatctccatctgaagcgtgtcctttagaaagccatccaatgcggaaaacggctcatccagcatgatgatgtcaggactgtacaaaagcatgcgggcaagcgccactctctgctgctggccccctgaaagctgggaaggataccttttttccagcccttccagctgaaaacgccttaactgttccgcaacaaggggcagcttatcctttttctttcccggaatcacaatctttaagttttcttctacggtcatggtaggaaacagggcataattttgaaacaggtagcccacacggcgttcccttgcaggcagattgatccccttttccgaatcaaagagcacttttccgtttaaaacgatccggccctgatccggcttttcgattcctgccacgcattttaaggtcatggtctttccgcagccggaggctcccaaaatccccatgcagccgccctcggcctcaaattccacttttaattcaaatcctgaaaacttttttcgtatgtttacctgtaatgccatatcaaatccacctgttcacatgtttcatattttttccggatatataattgataaccgcaactataaaaaatgacaaaataacgatgacgcatacccagaacccggccgtatcccagtttcctgccgccacctcggaagcgattgcaacggaaaccgttctggtctttcctaaaatatttcctgccagcatggtggtggctccatattccccgatggctcttgcaaaagccagcacggttcccgaagccagtccaggcgccgatatgggaacgatgatcttccagaaaatcttcccttccgacatccccagagttcttcccgcatggatcatgtcaacatccacctgctcaaaggccgcccttgcattccggtacattaaaggaaaagcgataacaaaggcagctatgacacacccaggccatgtctgcaccatctttatattaaattcctcaaaaaggaatttaccgaagggcctgcggaggctgaagatcaagagaagaaagaatccggccacagtgggcgggaggaccaagggcagggtcaatatcccatccacaatggattttgccgtattattcagcctcatgatcagccttgcggcggctatccccagaaaaaaggtcagcacagttgccagaatccccgttttaagggaaataaaaaggggactccaatctattgttttcataagatccagcatagattttcacccccttttatgtgtatgatttattttgcaggttttgcaaatccggcatccgtaaacatcttcataacgccttcatcgctaaccagatactctttaaagtcagctgctgcctttgcctgttcctctgatgcctccttgtcaatgattaagcctaccggataaacagcaggatcgatcatggtctgatctgcttctgcgataatttcaaccttgtctgccatggaagctgcatcggttgcgtaaacaacgcctacttcattgcttccttctgcaacagctgttaaaacagcggtaacattggcgccttcattgatttccattttcataacctgatcaagatttcctaagttggtgaacagttttcttgcatactggcctacaggtacatcctctcctgcaagagcaaggcttgatgcttttgtgatattgtcaaaaccggttacctcagtttttccgcctgttggcttgatcagaacgatcttattttcaagcagatcggtaacggaaccttctactacatatccgccttcctttaacgcatccatctgcttggttgctgcagagaagaacacatcgcactgagcgccctcttcgatctgtttctgaagggttccggagctgtctgcattataaataatattaacatttggatgatctttttcataggtttctttgatcttttccattgtgttttttaagctggcggcaataaacacgtaaaggtccacgttctctgcctttgcttcagccgtagtcgtttccgctgctgccgtagtttcctctgccttgctggtctcctctttcgcagttgtcgcctgcgttgcagcggttgaaccgcctgagccgcaccccacaaccgcaccggcagcaaacattgccgccatcataaccgcaagtaatttctttcctcgtttcataatacttcctcctggtttccatttgaacaacaatctatattgttattcattttaattgggttttattcggttttgttccgtttggtaattcccaattcattttagatgatatttaatcgaatgtcaatgccaatctatctttataataacatcggactttaagcttttagcctccatatgacagacagctcttaaagcctttcattgacaatggattaaaatatgctataactatttataaatgataaaaaccacaggaagcaaagaggaaaccgtatggaaaaaatatatactacccaggaagttgccgaccagcttaaaatcaaaaaatcgaccgtatatgaactgatcaaacggggagaattaaaggctgcaaaggtcggcaaacaaatacggatcagccaggatcagctggatgaatatttaaagactccaaagaacggcagctctttccagacggaagagcctcttccccggatcatggatattccacagtttacagctgatgccgcgatccggcagatggattaccttcttaataccagcggcctgatcataagcagccaggaatccagggtggcggagctgctccgaagccagctcagccttcaccctgacagccttcctatcctgcattcctatatgaatgattataacagcctgtattctctttattatgaaaaaactcatatggccctcaccgccttctgcaccggccgggaagggcaggaaatcagtcagatccaaaatcttctgcctggaaaggaagtcgtaatccttcatatctgcagtcttcaggcaggcctttacgtgaaaaaagggaatccaaagaagctgcgggccttaaaggatctatgccgccctgatgtccgttttataaacagggagaagggaaacgggtacaggatttacatggactccagcctctcagcccaaaacattgtaaagacttctatttcgggatatcagaaagaatgcctctcccacatgtcagccgcaaacgcggtcgcatcgggagatgctgatgcgggcattggtgatgtgtcccacttagctgcatatccccagctggattttattcctttgtctgctgcctccatggacttagtcttctccagggcggccatgaaccatccggcctttcaaagcattgccgacacggtaaactcccaggaatttaagaacggccttcttccttttaagggctacaagatcgaaaacacagggaaatgcacctttgtggacggctgaatgaaacgacattttcccccattaataaatattcggcaaaattttagttgcattcgcaactatttgtgtgttaaactaatttagagctaatagagtctgcaggctcatgcacaattctgtgcagataattattcttaagaatccctatcataaaaaacggacaacaggaggtatctatttgaaccaaaaattaaaagaaaaaattgttgaatctttatcatctgtcctgcccgttacatgtatcgtgttgatcttgtgcataacaatcactcccatgcctcttgacccactgatgctgtttctggtaggggcaacccttttaatcgttggaatgggcttttttacactgggtgtggatatgtccatgatgatcatcggagaaaaagcgggtgcccaactggcaaaatcaaaaaagctgccgctcattgtttttgcctgttttatcattggttttatcattaccatagcggaaccggatcttcaggtcctggcggggcagacgccggccgttcctgacatggtcctgatcctttctgtggccgcaggagtcggactgttccttgcaatcgcatttctaaggaccttatttggctggagcttatcccatatccttatgatctgctatgccgtactctttgttacatccgcctttgttcccaaagaatttctggctgttgcctttgactccggcggcgttacaacaggccccattacggtgccctttatcatggctcttggtgtcggcctctcctctatcggcagagggaaaaaccaggacagcgacagcttcggcctggtcgccctatgttccgtgggacccattctttctgttatgattctgggccttgcctatggatcttctgcagctgattatgagcccatggtgattccctccataaataattctcaggacctttggctggcctttcagcatgaacttcctcactatgcctgggaagtctttttggccctctttcctattttgctgttcttcctcatatttcagctcttctttttgaagctaaggaaaagacagctgatcaaaattatggttgggctcatttactcctacatcggactgacgcttttcctcaccggcgtcaatgttggctttatgcctgccggcaattatctgggtcagcagcttgcatcccttccctataactgggtcatggttcccatcggcatgcttatcggtttcttcattgtaaaggcagagccggccgtacaggtcttaaataagcaggttgaagacataacgggaggctctatttcggaaaagaccatgatgaccggattatccatcggcatggccatttcccttggattatccgtcataagagtcatgacaggtcttccccttctggctctcctgcttcccggctatgcacttgcccttggtttatcctttgtggtcccgccgatttttacatccattgcctttgactccggcggcgttgcttccggccctatgactgccaccttcctgcttccctttgccatgggagcctgcgaggctttaggagggaatatcgtaactgatgcctttggcatcgtagccatggtcgccatgacgcctctcatcatcatacagctcatcggtgtctcctatcgctacaagactaaaaaggccaatgtaccggcaagtacaccgctccttaatatggagcttgaattcatcgaattaggaaaggaggaggctgatgatttccaatcgtaaagtaaactggattacggtaatcgtagaccggggaaagggtgaaaaagcagcttccgtttttaaagaacaccatcaggaactgcttctcatcaccagaggacatggaaccgcaagctctgccatcaaggactgcctggggttagatgaaccggaaaaagatctggtcatcggaatcgtggaggaagcggctaccaaacgcttattatctgctcttcatgaaatattagagcttggaaaaccaggttacggcatcgtatttactatttccctgtcgggaatcagcgccgcagcttccagtatattagaagctaacctgtcaaaaggggatacgccccctgtcacagattatctcaaggaggatcgctctatgtcagatacgatcagatacgaactaattgctgctgttatcaataccgatctttccgctcccatcatggaagctgccagaaatgccggctgcaagggcggaactctggtcaaagccagagaggttagtacggatgattccaaaaagctttttggcctgaccctttccaatgaaaaggaaatccttctcattctggttccccttgcggataaacaggcggtccttaaatccatttgtgaaacagtgatgaaggaaacaggggaacatgccatcgcattttctcttccagtagatgaagtggccggactaagcactcttgtaaagtgagtgaatgctctatggaccggtccataaccaaaacaggcggcagtttcgtattcccttcatgggacaggaagcttccgcctgttttctgctatcttaagccgcgatacagggcgccaagaagctctcccttcggatcctggctcagttcccagaccatagcgccgcctaagtttttcgatttgatataatcagatttataacctatggactctggatcttcatagctgataaagatcgtaccgttaaacagccagggaacctttgactgagaatggagatgtctggtatagcctgctttatttaagtagttatccttaatatcctgatatccgatggaactcgaacctccaaacggctggtataatcctttgtttgaatcatttacagaagaatataagtatccataaagcggaatccccattaccagcttttctgccggaaaagaagcattcagccaggcagtgatccccttatccacacttattttatactggggggaaggatcgtcgttgtcatataaaggagccagaagatccgtgtgggaatcccagtagccatggagatcgtaggtcatgacatttgcataatccagatactgggccagctttgacagctccacattgtctatgtaagagcggtccgctcccctgcaatggtcagtaagtaatgcttattgttagcagcccctcgtgcatccagcttttcacgtatctttttaagaagcagggtgaaattctgcttatcttccccacgccttgcgttttccgccaaacctccgctgaccggatattcccagtctaagtcaactccgtcaaatccgtattttataatgaaatcaacacagctgtccgcaaatacggtcctggactcctctgtcagagccgcatctgagaatttcccggaccagttccagcctccaacggaaatcaaggtttttaaatccggattggtctgttttaaagaatttaaaagctttatattgtcaggatccacttcaggatatccaagcgtaacccttaagtcagcgccgatgtttgcaaaggcataattaatatgggtcagctttccggcatctatctggtttggatagtaattatagtaagcagcccatgctgcataatatccgactaatttgcctgtctgccggggagatggctccgtgacagacaaggctgacagctctgcgaccggcagggctgatgattccgctgcaagtgcttcaggcgatgcagacgattctgcggaaacaagagcagccgtttcagaattatccggaatggggctgggggaaaggggaactgcagtgtctgcaatgctggctgctgccgggctttgggattctgccaggaaatccttgccagacttttctgtaaatgcatctctgcttaaaagacatcccaggatgatcaacataaaaacagaaacaaacagaaatgttttcttcatagtactttttttcattacgtgatccttttctctcttttattttttcaagtataacatgctggtttttctttgaacaacgagcaaaaaatggatcaaatgcatatttatggataattttcttcttgattttttgtgcctgaaatctctgaccttattgcaatcacaggaaaaaggcccgctcaccgccagaatacaggcatacagagtttatttaatatctgaaattccaaataaaatacagtctactcttcgtcgattgaaacatacttttacgtatggtatgattggataaaaccgacctgaataatgaaaggggtgcatacaatgaatgaaacattgaatgtaatagctaagcggtattcctgccgcgattttaaaaatgatatgccgtcagacgaaatactccgggccatcgccgaagccgccatacaggcaccaagtggaatgaaccgtcaggcatggagggtaattgttgtaaaagacaaagatttgatacaggatatggaatcggagggcatggcctatctggccggcatggaggacaaatcctcatataacagaatcatggaacggggcggcagattgttttatggcgcaccatgtatgatcgtagttcctattgatccggcacaatatgctcccgcactgattgactgcgggatcctgtgtcaaaatatcactctggctgcaacatctttaggcatagccaacattatgtgtggatttgccggcctggcctttgccagcggaacacgtgcagcggaatttaccaaacgtctgggcttccctgatggttatgcctttggctgttccgtattgctgggatatgccaatacggaaaaaccgcctcatgttccggatcatgataaaattacttttattgaatcataaccaaaatggtaaatgatcagattttaagcgaaatcaggacatgtcataaaaaagaattgaccatatgaggatctttctttatattcatttaaaggggctgtaaaataagtccctcctgaaataggattcatatcagcgaacgctgatatgaatcctatttcaaattttatattgatttcgcccggaaaaataattatgatatctttgtttaagcaaaaaatgcgcactcaatgttacccttgggaatccaaggggataaatgattccatcccgctggctttttatgcagctgtcagtaaccggctttttttattatgatacttgtaaagattataactacatgaaattaaagtgagctcaagacttacgttcttttcgcctcgtctttagagccgtttgtacgacttatcccacttgattacccaaaggttccctctgcctgaatgcttcgattcattcgcaaaagtgctccatgaatggattccaggttactcatcacttcttggtggattgctgttaattcctgattcatgcatatggttctgttcccggatttctttttacagcagtcaggcttatatgggcagtcctcacagctttcacattcgtatatttcttctgttcttccatacttgtttttatatacttgtttcttgtatttaaacttaaatctttttccattcagacagataagagcacctgacttatctcttttaaagttgacagcccggtatggatcattgtggtatttcttatccgtggtttcttttttaaacatggtaaacttcatgaacttttccatgccgtgctcttcgcagtaaagataattattatacgaaccatacccggcatctgcaactggatatttgggataatgtccatagatgctgttgaacttttccatgagcggcacaaagcattccatgtcagaggcgtagggttttacatcaactgttgctatgtattcatcacatatcgccacctgtagattgtaggccggaaggagctggtcatttcccatatagtcccgttttattctcatgaaagtagcatcgcagtcggtcttcgaatagctgtttctttcatttccacatatttctatgtgctttgcatatgatttcagacgttccagaaatctttgcatctcctgatattggcgctgctccatactttttctgtgcccagtccctgacacaaactttatcatatccaggccggttgctgttttatagttttcaagtaattctgtgacataatcaatggcatattcatttcgcttttcaagttttattcccatatagtctaaaacatttgtattcatcgaatcaattaatgccgatagtttttcaaaaactttatcacggttacgaagacatgattttttccacacccaggtataacggttcgcatttgcttcgatttttgtgccatcaatatatgtatgctccagatccacctgatcctttttaaaaatgtagctgttaatatcggtaaagatctgttcaattgaatccgtcaattcattgcgaattagattcccaaacgtcgcaaaagaaggagccttcatatcatcaaggagatagatatatcgaatatcattcctgcaaagtttttctatttcacgcagagagcagatgccgtgcgccatgaaagcaaagagtataactttaaggagtttttgttcatcacatcttggacgacctgttttgtatcccttctctacaaaatatcttgataggtcaatgtgatccatcacctcacaaaaagtgtataccggatcagaaacattaattattttttcgatatctaatggtaatttcaactgacgtgaggtataattaccattggtgtggttttttagtcgcataattaattataccaaaaaatcgctgtggtctcacgacctcagcgatttttttagggaagtttttttacagcccctttattatttatcccggtcagtcattcatcatttctcttgcggcactgttcaaaaactttatgaatgcagacggaatcttctgatatgtgattcttgtaactggaaacagaattaaaatctgcagcatcgtcaaacataccatggacttatttagaaggcaatacatttctatttcacggagtcctctccctcttccgcctccagcaaataaggtgtgatctgatatacatagaaattcagccagttcccatacagcgtatttgccccattcctccaatttaacacaggcaatgtatccggatcatcatcctcataataattacagggaatagcaggatccagtccttttcccaaatcccggtgatactctccgtccagggtcatgcggtcgtattccggatggccctggataaatacctgctttccatcccggctcatcacaagaaggatcccggcctcttttgactccgccagaatgatcagctccggatgcttttcaatgtcctcccgccgaacctccgtatagcgggaatgaggcgccatcacataatcatccaggctgcgcacaaggggcaccttccggtccaggaccttgtggcggtaaataccggacagcttgctgtctctcttatattttggtatgccataatggtagaaaagtcctgcctgggctccccagcagatatgaagggagctggtcacatgggttttactccattccatgatcttttttaactcttcccagtaattgacctcttcaaattccatgttttccaccggggctccggtgatgatcatgccatcgaacttctttttcctcacttcatcaaaatagacataaaatttatttaagtggctggccgacgtattcttggaagtatggctctccagcatcagaaaggaacagtccacctgcaggggcgtattggacaaggcccggagaagctgggtctcagtctcctcctttatcggcataaggttaatgatcaaaatctgaagagggcggatgtcctggcttaaagcccggtcctcatccatcataaaaatattctctttttccagtatggcttttgcaggtaaatccttttgtactttaatcggcataatttattcctccagcattttttatacgaaaaatcaagcagatatgttcacatatccggttgattcacaacccctaggttgaaaggcgatcttctttcagccttataaaatcctcttctgagataatgggcactcctagttcctttgcctttttatttttggaagaattggatgtagtatcattgttgatcagataagtcgtcttggaagtcactgaaccggtggccttgccgccgtgggcttcaatgtcctcctgaagggctttccggttttcatagtggttcacagaacctgtaatgacaaaagtcattccttcaaagattccatcttcccggacctctgcctctccctcaatggtgagctcaggcaacaggcggtccaccatctcgttgttcttttcttccttaaaataagtgatccaggcatctgcaagcaccttgccgattccgggaactgctgtcagctcctcttcctcagcggtgcgcattttcccaaaatcaaacttaaattcctggcacagcgtctttgcatttgccagaccgattccagcgatccccaggccatagatcagccttggaagggtggtatgggaggccgtttttactgcctgaatcagattatcgtaggatttccttccaaagccctccatctgggtaatggtttcctcatgctgctccagatggaagatatctgcaaattcccggataaatccggctccaatgaatttttccagggttgcttccgacaatccgtcaatatttaaggcattcctgctgacaaaaagggaaaagcttttcagccgcttggcctgacagtccgggttggtgcagtacaggctcttcacatcattaaccttgcggatctctgtttttccgctgcagacaggacattgatctgggatctggatttttttgcttcttgtcaggttatcggcgatctgaggaataatcatattggccttataaaccgtgatctcatcgccctctcccagctccaaggcctccataatgcttaagttgtggacactggcccggctcactgtggtcccttccagctctacggggtcaaagattgccaccgggttgatgagcccggtcctggacgcactccactcaatgtggtcaagccttgtttcccggatctcgtcggcccacttaaatgcgatggcattacggggaaatttggacgtacgtccaagggcttctccgtaagcgatatcatcaaacaaaagcaccaggccgtctgatggaacatcatagctggaaatggactcagaaaactcctctacagcctccggcagagtatcccttgtcaccatacgataatccaccacatcaaaaccctgcttttttaaccattcaaactgttcttttctggaattaagaaaattaacaccttctgccgttacaagagcaaatgccttaaagtttacatttctccgggcagtgatctggttgtttagctgccttacggaaccgctgcataaattcctggggtttttgtatctggcggctaactccccgatctcttcgttgatccggttaaaatccgaatacttaatcactgcttccccacgcaggatgagttctcccttatgggatatatttaaaggaatattggaaaatacttttgcattgtttgtgatgacctcaccgatctctccgtttcccctggttacggccttttgaagggtcccctggttgtaggaaaggactacggtcagcccgtcaagcttccaggacagcactcccgtctggctgcccagccactcctgcaggctttccacgctcttggtcttatcaagggaaagcatgggtgtttcgtgggcttccttgggaagctcgcttaaaacctggtatcccacgttctgcgtcgggcttttggagagaatgactccggtttcctcttctaaatccttaagctcatcgtaaagcctgtcatattcataattgctcatgatctcccggctttcctggtagtaggcctttcctgctgccgtgagaaggctgaccagctctttcattctgcttattttagcgtccatcagatatctcctttttctgttctttataggaacgatttgtcgagccttttaaggcctctttcatctggtggtactcccttttcgaaagctcccggtaagctcctggctttaaatctcccagttcaacattcatgatccgcaatcgttttaacatccgtacttcaaagcccagctggccgcacattcggcggatctggcggtttagcccctgggtcagaataatgcggaatgctttttctcctgcctttgtcacacggcagggactggtggtcacatttaagtccggaagaaatactccctttttcatcttccggatgaaatcatcggtaaccgggcggttgaccttcaccagatattccttttcatgagcatttccgctgcgcattattttattcaccagagagccctggttggtcatgaggatcagcccttccgaatccttgtccaggcgtcccacaggataaatcctcgcggggtaattcaccatatccacgatgttgggggcacggtctttatccgatgtggtacagacgatgccttttggcttatggactgccagaagtaccggatcttccttatgggtttgatctccctttcccgcagaaacggtccgtccgtttacggtaactgactggccgggaaaaaccctctgaccgggcgtggctgcctgtccgtttatggaaacctttccagcctcaatgaagcggtccgcctctcttcgggaacatatcccagcttcacttaaaaatttattcagacggattccttctgtctccatgtttgttctcccttactgtatactaaattaaaattatagcattaccgggaaggtacgtcaattttatccgcacattttgaccggggttttctcccatttcctgggcagccgtatatttaatagaaattttcaaatttttacgtaaaatgcccttccattttatatctagagttgaattttctggaattttattataaaatataggaagatacataaatctttttatttactttaggaggaattgctatgccgtggacaccaaatttatctgtaggaatatcaatgattgacgatcagcataaaatgtggttcgataaagcagaaaagctgtttgaagcagggaagaataaccgggccaaagaatatgtaggagaacttcttgactttttggatgattacacaaaaaagcattttgcagacgaagaaaggtatatgatcagcattcactaccccggctatggggagcagaagcaggctcataccgctttcatcgcacagctggacaaaatacgcagtgaatacaagtcttccggaggcaacttactggtgattttaaatgccaatcagatggtcgtggattggctcacaaaacatatttccaacatggacaaaaaaataggtgagtacgcaaaaagtgttcacaaatgatttctcacgaaaaagggcagcctctttggccgctctttttcgtgtaatgtcaagcggatattcgcaatccgcttcgctgcttgcttgattcggttaaataaacttatatttcacttcacatccgtaggatatccggctgcagatgttcaccacccgctccatcacagcagatatttttcccgtatcaacctcaatatccatttcttttaagtcttccgagattctgatatcctgcaccccgtcaaccttggcaatctcgccctcgattcttctggctttcaaccggtctgacagggcgtaaacgtggtagattcggctcacgcttcaccctcctttcccattgggtattctacccctattgtagacaaataaaaggggttttaaacatcagagaaaggcccttgcaacggtcgtgaataaaaagcacaccacaaacccggttacagtgggtaccagccaggaaacagccgtccattttatgctctgggtctctttcctgatagtaaggcaggttgtggagcagggccagtgcatcagggaaaacagcatggtgctgacagcagtgatccaggtccagccattggctacaagaagttctcttaagacggataaatcgctgatatcccgcagactcccttctgccgtgtaagccatgatgataatgggaaccacgatttcattggccggaaaacccaggataaatgccagaaggataactccatccaagcccatgagtctggcaaaaggatccagaaaaccggaacagtgagccagcagtgtggcatttcccaccgttatattggccagaagccagatgaccaggccggccggagccgccactgagatggcacggcccaatacaaacagggttcggtcaaatatggaacgcacaatgaccttgccgatctgaggtcttcgataaggaggcagctccagggtaaaggaagaggggaccccttttaatatggttgccgacaatagctttgatatgacaagtgtcatgaaaatccccagaatgatcacgcctgacaggatggccgccgacaatatggaggaaaatgcaccggaggctcctcctacaaagaacatggtgataatggcgatcatggtgggaaatgcgccaccacccaaaaggcaactttactccgtacgacgagtaaagggctgacagttccttactcgccgtcaataaaaatatgaagatcctttccatcccagacaattttcttgaccagcaatttgattaaggtccgcttctcctcaatggacagcctgtcaaaattatccttgaagctggatagtaccgtagacagcatatccacttgaatttccctgtcgcttatgatattaatatctttttgcagataggcttgctcttcttttaaggaagataattctttgtcaagctccgtgattctggcgtttattcgttcaatgaaagcagttcctaaattcccatgtgataatgtattgattaagttctcaatctcactgttgcttttttttattctctcatcaatatctgccatggggtttttttgaacttgcccctgtaaatcacgtttcagcttttccaacagcttgtagatacctgaattttcattggtatactgcaaaagatattcgcaaaccaaatcatctgcctgctggccgttgatattctgacagtcacataaggctaaacctccacgcaatttattgttacagatataatcatacaaatcacggtttccgctttttccgctcctctgctttgcaaacatgcggctttggcatttgccacagaagatcaaaccagacagcagggaatagtcattgtgcatgaccgcaggtttctttcctgtcggtatattgttcttcagggtattctgaatttctacccactttttaccagatatacgccccttgtgctttccaatggatacaatccatttatctatatcctgccgcggagcattcttttttctgtaatcacgtttattataagctaacaaagcatatttcccggagcactcagacttattaaagcaaacatctgcctgatgttctgtaaaatagtcccacgcatcttcatcagcaatacaataaaccggattttgtaaaatctcttttatgcctgataatgaaaatatttttccggtacgtgatacgattccctgcttgattaagtatttactgacacccgacacactgcgaagttccaaaaatttttcaaaaatacagtcaacggtttttaattcttccggattgtcctttaatttgcatgaagttttgactttaccatcaataacgatttcctgcattttttcggaggtgaatcctgttggggtagtacccccagccagcggccagtccttgccagcatcagcatattatcacggacacgttctgctatggtttctctttccagttgggcaaaaacagaagctatatacatcatagcttttcccataggttttgatgtatcaaattcttctttgatgcagataaaagaaatatcgtgattattcagatcctcaatcagggaagaaaaatcactgacatttcgactgacacgatcaagacgataacaaacaacataatcaggtttattggcctttatgtcacggagcatttgctgaaactgtggtctgtctgtgttctttgcagaaaaaccttcgtcttcataaacagttatcactgcttgatctgcatgggggagtttggtaaaaatatactctttgcacatttcaatctgattttcaacactttcccccttgccagtgtaaatcgactttcggctgtaaataaagattctcaaaagttattcaccgtcctttttctgtatcatagagacaattagccagaaaagaggaggttctttaaatcctccccttttctaattattaagagataaaaacagtaatgaaatgccattccatatcttgtttcggcagcattaaatatagaaccaagctgattatttttcctttaaatattcctatgctttttaacaatcacaccaatcgggaagtcccattctctatatttaataccttatacttcatactgcactgttttttatcgtgagccaagccaatacagattacttcgcctttcagtcccgtataatatcggttatcaagtatttgctgtaacgcttcctccttcagacgttctaaatcttccccctgcttaaattcaacaatcacatgactgtgggtaggcatcaaggcctccagagtaatatcacttctcccatatccagcttcaatgttactagtcaccttataagaccctctaagcgcaatgcacatccccaaaaacatcatatgatacgcattttctctggcatccatatagctggtgcatgatatgacaatattctgatataattctaaaaagcgtttcatatcctttttaagaaggcaggaaagcatctgctgtaaatccagtccgtcaactcctgatatttcagcaatcagcatctgaaactccgacatcacttcatcattaggtatctttacaaccacagtattggaatcaatccgtcttaaggccgtcaaatatccggaatttaccagaagcccccacaagctgtaattactatccctctctatataggaagtctctaaggtaagccatatggggatttcttttccttccgccagctgatcaaagtcatcccaaaactgcttatctgctgtctccaatgcctttttcaccaaaaagttagaagatgtattaatccagtaattatccagagaacccatgtcagcataatttaaaatggaccacggattatacatctctatacctccaaaacaatagccatcgtatttgtcttgcacattttcattcaatgtaagtccataatccattaaaagtttttctgtctccggagcagtgagaccaaaatatgaggcatattgtttgtgcagcactgtataaacccttgcattattaaactgagaaaatatgctttccttggcgaccctctgtactcccgtaagaagcgcctggcttaatgcagcatttcctttcattgcactcccataaagattggaaaagaatgttccaacttcatggtggtaaccaaattcatagctgcttataatgggctgatcatactcgtcaattaaaagaattgggctaaagccataagcttcctttacaaagtgcgtcaactgttgaatggcagtagaataaagggcatgaggagcttgtggatctctcagaatctgaatcatagcataaaaatcttttgattcaaaagagtccttatccattttatcccgcaaaagtttttcatatcgcagatattcctgatacagcttctgtttaacaagaagtaacagttcatcagcagttgttcctttacaatctttaaatgtaaaataaataacgggccttgaattcatcagatccacatattccgtattcatgattgccaatccatcaaaaatatccctgctatctatttcaatgtcaaaaaattccctaagcattgtcatatttaatgtctttccgaatctcctgggacgggcaatcagggccacttcatccttcatctcaataaaatcctttatcatcagggttttatccacgtaataggagtcattttcacgtaatttacggaaatcatcatttcctatcggtaagattctttttactcccatgccttctatcctttctaaaatatttgcagtacatcttatccacataatatcatattcctgccattcttaccagtccaggttccatgtattataccgattatactatttcatcagttcctgaagcttccggcaatttatagattagtaagaaactttttatttaataccttattataatatacaattctccaaacaaaagctaacaacactcataaaaatcccacattttttattatattttctcaaattatttgtataactgttgatgattatctccttatagcactccagcaaattagtgcatgtggatatatgcactaatttgctggagtactatagttgctactgttaaacgatccatagataaatcttcaatcccttaagggacctaagttccttaagacttttaaaattagagacactttaagtaatatccacctcccccataacaatattaataaaattaaagcataatcccctggtataataattggggggaagaaacaactaattttctgttgtatcttccccattgattattgattcaaattaacgtttccagcgtccttcctggtcaatcagatatccatccggtgtcattccattaaccagcatgtctccatcagccccgagataataccagctatctttgtagaaataccactcattacacttcatcgagccgtccgaattgaaatagtaccacttttcattcaccagtgcccagctatcggcacacatggagccgtccggattcagcagataccatttattctggtcaatcagccagccggtctgcatattactttcctgatcgaaatgataccatttcccattgatcttcgcccattcatttgtcgcatacgttccgttattctttttaaacttccatggctcattctgtccacccagccacgttccggttacattgtcattcggcgtataggtcacattatcatcatcgttatcgttattatcgtcattatttaccgaacgtcccagaaccttgactgtgaagctgtcacggaaggttttttcctcaccgtttttatccacgccgtcatacagcactttgattgtcttgcttccctgggcttcaaaggacggaatgtccagatcatactcatcctccgagagcactctttccctgcgttctgcattgctggagcttgcccttctttcataggccactaccttcatgccttccggatcaaagtcctcgccggtcttataaaccgtcttatccggttttttctttacttcaattcctgttgtataatactcttcccaggcttccgctacttttacggtaaaggaatctgtaaatacttcgtctttcccctcctcatttaccgcctcgtaccgtaccacaacttttttcgttccggccgtatcgaactcttcatgttctacctggtactcatccggttcaagttccctcgccttccgggtcgcattactggcacttgctttttcgtaagccacaaccttcattcctgccggatcaaacgcttcaccggtctcatacgacagtttatttggttttctcgtaacttcaatttcggtagtataaacttcaccctccggtacttccatcacttcaacagtaaaggaatcactgaaatcctcttctgccccttccttgttgactgcatggtatacaacggtcactttcttcgatcccggggtatggaagctgtcatgctctacctcatattcctccggagaaagttctctcgaccgggcggcgttgcttgcgctggctttctcgaacacagtgacttccattccgtcaggcccgaacacttcaccgactgcatattctgtctggtcaggctcttttgttactttaatactttccgtgtaataaccgttttctgttcccttcagttcatcaacagccttcttaagcacctttatctgatcgtctacttccttctgggttacatacggtttttctgctgtctttctggcctcttcaatcacctttttgatggtttcaatcgcttccggagagtagatatctgtcttctctgcttctttttcagcttcttcaatcagagctgtcaaggcctccttctctgctgacggcacctcaggattgcgcagcgcctcagtaactgccggcagatagaattcttcaattgcagcaaagtttggatgcgttcctgatccatttgttccaggcagaccattactgcccagggaatcaaaagtatacttattcttgtgagtctcatttctggtatctaattccgcgtcgtcatagagattggctacagccacatcccactttgcacaggccatcagttccagctcatgaagtttttcctgtacaatttcatcccgtgaaccgagtttatgtaccgctacatagattaattgcgctcccggccatttctgcttcatttcatggattgtcttctcaaatgcccctgcaaacgtatctggatcaaaggactccggatcactgctttcacctatggtaccaaaagcttcattgtccttatccacaagatactccgcgtcatttgtcccgccgttaaagatcacgtaatccggtgtttcttccggcgcgtcattaatctgggccaggatctgtccgcctgaataattggcctccataattgttgcaccgtttaccgcaaatttccgaagctccattccctcctgatctgctgcaaaatcggcaaagctgtgtttcgtatactgatgtccggcaacgatactgtcaccaaaagcatataccgtatttccttccagaggcagttccgatgtttcttccggcgcagtcagcttgaaattatcaatatactgaggcttggcatcccaccagttgcaggagatcattttcgccagattgacagcctctgtcggttcgtcaactttctgtgcaacaaccttgccgtctgcttccgcgatggagtagctgaccgttttctcctcaaaatcagcatgtatacggattttataagtcgtgttcttgttcatgtcgatatggtcccagaccggttcttccgttgctgccgcctttgaatcatccacggcgcctccggttacggatgatctcaaatcattcttatctgctgccgcacaaattgcaaacaacagtcttccgtaggaatcccggaattcaaatccctgtttatttcctgctttgcagaagtaatcaaacgttaagtcgattcccctctgtcctgtaactccaggtccaaaggttttgactgcggtagttgcatttcccataccgcctgccgtaagtaccagctttccatcctcaactttcgttccaaatgaaaatccgaagttctcaggctctgtcggtgcatcaaagttctcatcaattaccgtatttaaaaatgcttccggcatctcctccattggaatcgctatatcgtgctgattaaccttaccgccttccagcgtaatagtatcagttatgtcttttccgccatgcgttactgtgatcttagcttcaccgggaaccagtccttccataatggagtaggcaccgctctcattagtctttgctgtaacggtcttgtccccaatcgtcacttccacatccacactggcagccggatttaacccctccgtaacgctgccccggagaatgactgcatcaggagccagacggacttcaaacatgccaattgtcggtgcggcactgtccgcttcaatctgtgtctttgctgaatcaaaaaccgcctcaacacccgctttttcaaatgtaggataatccactcttccaatgttgatacagttacccaggaaatcggtatctgactgatccaatggagtaaaattaaacttcgttccccttgatttcagcccctcatttatgctgtatccgttaggatccttatctacccctgctccaatcagaggagaattcgctttgggtcttaagccatttgcttccagaagaacaccggtttcaaaacttcccattctttccagagacggtgcttcaccctcaaatggatcttctgtcagcagaatcggatttttgtccttacttgtaggtgctgttccgtaatatgcattattgtcaaaagcaaagctgctcccgccgctgaagttaaatccctcttttttgccgtcgtagaatacattattgaagtaggcaacatttccaccgccccatgggtcgaaattgctggtgccgttaccgtctttgctgcgatagaatatattgttataaatctggaagtatccgcttcccatggaataatggacgtagctgctgctacaatcctgtaccagattataacggatcactccggagttaaactcaacaccgcacagaaggaacccttctcctgcatcgtgaatgtagttgtactggatcaaagcgtttgttacccgccagtccggatcaatagcgttgttatcggcgccgccgcccttatgaattatgtcagacacctcattatactgaactgccacattgtctgtaaaatacagttcgattccgcaggttccgatatgttccagaacattcctctgaatcacggaatccctgctgctggttaagtaaataccattgcaggcataagccgaagcaccctggttgatgtagttatcctgaatgataatgttgctgtggggataccagtttgaatcgtagtagtccggtgccccatttgttttgcttcgattcgcccagcccggatttgtcgagtattgattgccggaaccgttccactgcttaacagtaacagcacagaaggaattattgataaattcgctgtcctcgatcaaaatatcactgaactgagtcggctggttgccgctgggactcagacactcaatcaagattccgccggtacgcttggagccgtcaagtcctgcgttgttcataatcccggcatccttaagtcctgtatctccaatccagctcactactccggtcacatcatgtatctttagatcatggagatgatagccttttaaagaagccacatcacggcctgcgatatggattccccggtaatcgcccaacagtttgccgtccttctcatcgcgggcggcattattggttatgggtggagttccgtctccggttccatttcccgataattgcgaaaatccttccacggtattagaaatatccaaaccggtaatttcccagtactcctgattgtacaggcatactgcatcagcggctttaccatttgtggaaatcttaggcatggcaccttcgccataggcaccgatgactattttttcttctgcgctgccgcttccctggggaaacagcgtctcgttctcccactcgctgccgcaccggaacagaatctggtctccgggaataaaatgttcccggttcacacggccaagagtcttccatgcggtttcctcagaagtaccggccgcgttgtcgtcgccgtcgctgctcacgtagtatgccgcggccgtttcatgcttttgctggcccattacttttacagactggatataaacggttccacggccccagctgtccgaatagaactgaatcgtatcaagactgtctcccacggttctcgccttctcatcatacagcacataggcgccatccacagaaacacggaatgtatctgtttcaaggttaatatccatgcggacagtctgccacgttcccggagcagcagcgcctgccgccttctggttattcttattttcaacatgcgtcttaaactgatcccagtctccgtcaacaaagagtgtgtaagccacttgtccgcttttatctttcatgtacgggatgctccactgatttgcatggctttccgtaccaagcttcagcttcgtctctacggacacataagtgtactgacttttctcgattcccagtgaattttttactaattgtgtgttgcccccatcccctgtccgtgtgagcttaagcgtttttccctccgctccttctcctgcgtcagccagctccgccgttccggaacctgcgctgaccgtccagccgccgggcaatgcatccaggctgtccatgccactgaaatctactgctgtaatttctttccagtaacccgtatcggctgcttttcctccgctttccggtgaggccagtgaaaacatacccgatgccattgtcatactggtcacaaggactgctgctgtcatacgccgaaaccattttctctgcttcaatctcatacaattctccctttccttttttactccttctgctgtttaaggctccctaaaacagccttcaagattttcctatattctatccaaaccgggcttcctttcctatgtaatattccgataacttggctgaaaaaatccgactttgtggtaattttaatatacttatatacttcaatcaggttaaaatcaccattatgcacaaaatcggaggcatcttctgagagatgtctccgattctatttctgcgccgccagtattataatcagttattacgtgctaatatttcatttgcctcttttcggaaattttctgccgcttcttttgtcgatatctgtccataaaatgctttatatgcactgttcttaaaactttctcccacttctgcaatgccaattgggtctggtgcaggagtttccccggagaactctattaccgtatctgcatattcaaacatttctttttgcttctcgtccatttttccagaattaattaaaaattcccgcacgtttgcaggagccggcacgcctctttctgccatcataatttcattcgcttcctctgagttaacaaaccagtttataaacgccgctgcctcttccttaactttagatgtttctgatatacagaggaaataccctggcttattccacattgcctttttattatcaggattgactggcggagttgtaattttcagattactgtttctgctgctcatcttacttgcataattattattttcattaatcatgcctgcttctccggttactacaggtccggcttcctgtcctaatgtctgaatctgtaaatattcgtctggattagccgcagcgcctgcatccatcagccccttccacatatccagataatctgccaggatctgatcctcctcatatcccaaagattttttatcatcactgaacaattgttctccatgctgccttacccagtaattaaaaaggtttgtatcatcaaccggacctgaagcagcacctaactttccagttgcctctttaatctcctttgctgtggctacaaaatcatcccacgtccaatcgcctgacggatttagttcttccagtcctgcttccttaaacacttctggattatatcccactgcaattgtccctgttgcgccaacgattcctgccattttatcgtctatttttcctgtgtttaaaacattctcggaaatttcagagacatcgatcgtaccattatcaatataaggcagtaaatctgcaattgaatgattcttcgcataggttgcaatatataagtaatccatttggacgatatcgggcatagccccggaagcagcctgtgttgataatttatcaaaatatccgtcccagccagatggaagtgcttcgaaagtaacatttggatgaagttccgtgtatttatccagaattttttgagtatattcgtgtctattttgatttccccaccatgaaaattttaaggttacaggttccccggcattcctatttgcctgttctccctcgcttgtgtgatctgccgaagcactgacgctttgagccgcatgattactttcattgccgccgcaagctgccaatgaccccatcatgataccaacaagccccaatgccagcacattcttcattctttttctcataatatatcctcctcttacaaaacttgatttttcttctaacattctatcataataattttttatacaaaggtaattttcagacaagagaacaggaaaaaaccgacttttaaagcagtatttccttatttgttccataaaagatatcatcatgtccagccatcatttcacagaatttttcaaattcattccaactatcatagtaatcaaattcatagctgtgtccccaaatataataaacctgcaaaacctctgtatttaactttaaaaatttctctccaagttccatcattttatcaaattccaagtgatacacagtgggcttatattgcagtaaatctttctgtatatcaaaattataactgcttattgtagttctggcatactgtatttttgtatttctccttatgatatctgctacacgttcatcataattgatcccgcctccgggatatgccattcccaccacctcttgttttataagactctctaacttctttctatcctcttcaacctgatgaattacttcataatcatttaattccgtcagacggggatgcgtaagtgtatgagccgaaacttcatgatttttatatacttcagatacttcttccggttcaattttattatgtccgatccacatgttttcccgtcttaaataccccggagttccaagtaattcggaatttatattaaaggtagctttcagtccatatttattaaatattttcacaagccgcttgtcctgtgttaccccatcgtcataactaaatgtcaaaaactttttctggccctgaaacatagtactttatacctccttttttttctatcataccctttctatctggaattaaaatggattttacctgcttaaaatctgaaaaaaacctacaatttagaaaaatcagaaaataatgtttgacactatcttcttcctctgtataatgattacatataaatagcacggctcacactgagtctgattaccatacggcagcttaatcatacacataatttattcatggtaaaacggaggaagatatggaaaaagaatttgacgtatttctgtttctcggtcaatcgaatatggctggacgaggcattacttcacaacagtggcctgagactgcaccaacactgacgcctggggctggaaatgaatatcgtgcggtttccgatccggaatgcctgcatgcagttaaggagccttttggagaggctgaaaacaatccggagggtatttatgaaccgggaatgaagaccggttccatggtaacggctttcatcaatgcatattatgcaaagaccggagtaccggttattggggtttcagcaagcaagggcggctctgctattggtgaatggcagggaaacagcgattatttatccgatgcactcgtacgctttgaccgcacagagaattatctgaaagaacagaaaatagcagtccgccaccgctatatgctctggtgtcagggagagactgacggggatctggggacttctccgactgattataaaacaggattcaaaaatatgtttgctcaccttaaaggaaaaggaattgaaacctgcttcctgattacaattggcgaatacaatggtaaaaggggatttgattattcaaaaatccgtcagacgcagttagacatagcagccgaacttccagatgtggagttggtttgtgacaattttcacaccatgcgcggccgcggccttatgaaagatgaatttcactattatcagaaggcttataatgaggtggggactgccgcaggaaatgcggctggagaatttgtaaatggattgtattaagcaaattcataagcaaatgattacagatacagtattttgcttaatcgatcgggataatcacaatacgagcaggggagagttaatcactcctgctcgttttttaattaaccttttattccatccatagcgattccatccaccagataccgctgaaagatgataaagaacagaataaccggcagcagtgaaatcacggacattgcaaacaaaccgccgtagttattataagagttcggatcgagatacatatttaacgccagcggaatcgtaaagcggtttacgctgttcataaagatgagcggctggaagaaatcctgccagatccagtaaaatgcaaagatggatgacgtaatgatcgccggttttaccaccggtacgaggatacggaacagagtcgttatcttcccgcagccatcaatttccgccgcctcatccagttctctcggaattccacgaaagaactggaccatcaaaaagatgaaaaatgcgcctccaaatatccacggaaggacaagcgccgttctcgtattgattaaatgcagctgctttaagataatatattgcggaacaaccataacctgtgggggatcatcatggtcatcatgacacagccgaaccagaaaccggaaaatttaaatttaagtctggaaagcgcataagctgccagcagggaagtaattacgcagcccaatgtaccaataaccgttacaatcagtgaattggtaaaaaatgtgataaatttcacaccgccaattcctgaaaaaccactgttatagttggtggtcatgtcccataccttcgggatcagagaatatgtatccagaaacatggtatcattactcttaaaggagctggctaaaagccagagcaggggatagatcatcaaaaatccaagcgcgcacgctcctacatgaaacaaaaacgaatttatttttttctttgtatgcattcccattctctcacccctcctcagactcgtaatatacccagttcttctgcgttttgaagataatcacggtaaagactgcgataattgccaccagtatccaggcaagagcacagctgtagcccatatcaaagtaggtaaatgccctgcggtataagtaaagcacgtaggacagcgtgctgtctaacgggccgccatcggtgattacatagctttctgtaaatacacggaatccgttgatgatctgcaaaatcaggttaaagaagatcgttggggtcagcatcggaagcgtgattctgaaaaatgtgtaggaaggcttcgccccatccaccatagccgattcatacagagtaaaaggaatctgctttaatgcggataagaagatcagcatagaggaaccaaactgccatacgcccatgagaataatgacactgagcgccgttttgggattacccagaaatgaggtggtctgatggattccaaacacagaaagtaaagtcataaccacacccttgtttccgaatatttgtttccacacgacagaaactgcaatgcttccgcctatgatggatggaacgtaatagagtgtcctgtaaagtccaagccctttatgcttcttatttaaaagcatggctacaaacagagcaaatgcaagtctcaatgggaccagtatcagaacatagagaactgttaccttaagcgcctgcacaaaagtttcgtcctgtgtaaaagcacgagcataatttgcaaatccgatgattttcggatcatttaacagattaaaatccgtaaaggagtaatagatggaaataatcgccggaatcagccacattccaataaatccaacgagccatggcgtcatgagcaggtaagcaaccgcattgtcggcgtgcctgattttctttttacttttcataattataattcaatctcctctttattatcagaggggaccatgttgtatggtcccctccttctgacgatcagttattccgtgaaagtattgcatccgcgtcttttctgaacttagcagctgcttcctctggagttacctgtccgtagaatgcgctgtaagccgcgttcttaaaggactcgttcacctctgacatgcccacaggatcaggatcaggtgtctcaccgcagagtgccagagcatcttccacgcccttaaacattgctgcctgctgatccgataatttacctgatgcgaccatgtaatcacggatctcggatgatacaggggttcctctttccgccatcatgatatcgttggcttcctctgaattgacaaaccagtcgataaattcagctgcttccttcttaaccttggatgtctctgcaatcgagaagaacatgccaggcttcatccacagtcccttggtgccagaaccggcaaccattggcggagtcaccattttcagcttgtcattggttccgcttacctttgtcgcgtagttgttccactctgtcagcatagcgccttccccggttacaaccggtcttccttcctcacccagagtctgaatcgccgcatactcatccggattcggtgctgcgccctttgccattaagtcagcccacatttttataaagtcagagcagagcttgtcatccgcgtagccgattgccttcttatcctcactaaataggctctctccatgctgtctgacccagtaattaaataagttggtatcatcgaccggaccgccagccattccgtacttaccagtcttttccttcactgtttcggctgttttgataaaatcgtcccaggtccagctgctggccggctctgccgctcccgcttctgccaacacctcagggttataaccaactgataaataagagctgctgagcaccagtccgtttaattttccatttatattccctgtgttaagcagattttcgtcaatctttgatgtatcaatggttccgtcatccacaaactgctgtaagtcagccagtgaattgtttttcgcatatgttgtgatgtaaaggtagtccatctgtacaatatcaggcatggaaccggaagctgcctgggttgccagtttatcgaaatatccatcccagcctgacggcatcgcttcaaacgttacatttggatgggaagccgtgtatgcgtccagcatcttctgtgtgtaatcgtggcgcccctggccgccccaccatgtaatctttaaggtaaccggttcaccggcgctttccgcactgtttgcctgtgtctctgtctttgaggtttctgctgatggagccgccgtgctgcctccgcttacggttgtctcccctcctttaccggaaccacagcctgccagcgagaacgccatggccgccgccatacccaaagccgtaattttttttaaagaccttttcataaatacaactctccttttcttacctgatttttgtttgttttgataaccttattatagcgtttttgtatatagatcagaatggaatttccagattacctatctgtaaaattccgacaaaaacagctttaaaaaaaagcatctttgaaaggatttatctttcttagacgctcttttttcattcatttgtaattttccgactttcattgactgttaatatttttcggtattcagacggtaccatccctgtgttctttttaaacactttagcaaaatactgcccatctgcaggatatccgatctgctcggctaattcggatatccggatatccggatcaaaagtcatcagccgttttgccagctccacacgaatccggactaaaaacgaagaatacttttcgttggtgtagcgataaaaaaaacggccaaaatagtcttcgttcataaaaagcacttccttcgccagatactgtaagctcaagttcggatttttgatattctggtatatgccatacaggatatgcttgatacggcatccatcctttgtatctggtaatgacaatttcaagtaatcggcacatttatcaattactacttggaggaaatcccaggtattctcgttttttagatcgatgttttcttttccacagaaaactttcaagaagaaacgaaaggaatccgcaatcctgttttttgaaaatccctgcatctccatctttacaaaggaagtatagatctcaaaaatcacctcggcgtaatccttcgctgcccttattctatcgtaatccagcaccataatggaattttctttggtcccgcccagcagatcaaagcttataaactccattttcccttccagatccccaaaaaagaacagttcctgaagctgagaataaagaatgctgacttcctccatacttcctgctctactgatcgccgaacggagcttcatctgtttatattttccatactccttatgaacctttatgatcaacggccgcagatttcctgccatttcttccggaatcagataaatcatctcattctttgtggaagtgctcatatagacattttccacacctaaaagctctgttaaaatgtttgtcaacgcaaactgatccagctgatcccactcctgggggactgaataccgagcaaaacaaatgaatttttgacatcctccataaatttttccagaagaatttcatcagacatggatacttccttttttgtgatcaaaatccccaggatctgttcttttacacggggaagcattcgatcaaaggtacttttatattcctgttctgattttctcctattctccaactcggccagttcctttttcacgccctgcagcacttctacaatcttttcctcatcacagggctttaaaatataatgcctgattccaagctccatagctctgctggtgtactcatattccccgtatccggaaagcaccacaaaaagtatatccgggtatagctcctttgtatttcggatcagttgaattccgtccataaccggcattttgatatccgtaattacaatatccggaatgtgcatccgtattttttccagtccttcaatgccattccatgccatatctaccagttccatatccaacttcttccacggaataatctctgccatcgcttcgcgctcaatatcctcatcgtctaccagcaataccttaatcatcatctttcatcacctctaccttcggaattgtgatcgtcacagtagtcccgtttccgcagacactgcttatactaaatcccgcgacctgatcaaacgccatttttaatcgttcataaatatttttcaaaccaatgccgtggcctttgggctctgcggtaaaggaacggaccgctttcagttcttcctctgtcataccagggccgttatcagatacggttattgcaatccgctccccatcttctcttattgtaacggaaatcgtacacggcatcagcatcttttcgactccatggtagatagagttctccaccaaaggctgcaatgtcatatgcgggattaagtatcggcctgctgcttcgcattctacagaaaaagtcacacgctttctatacctgtactcctgtattgtcatatattttctcagactgtccagttcttcctcaatggtgacatactgctgtttgttcagggcagaccgcaaaatcgtgcccagcgccaccgtcatttccgccgcttcctcattttttctggctcggatcatccagttaatactatttaaggtgttataaagaaagtgcggattgatctgcgcctgcagcatcttgtattttgtatcttttaacagaagctgcttttcatagttttcatgaatcagattatcgattttatccagtgttactttaaattcctgagtcatcagaccgatctcatccttctgcgaactggttcccaaatacgctcttgcccggtcaaagtccccagtttccacgatctgcatacttcccgttaaatgttctaacggtttcacaatcatatgcgcaagtttcttcaaaatcagcgcggtgacaagaaacagcagcagaaaccctccgatcatcagatatctcaggttctgattctgtccgtaaatttctgaatagggaaagacattcacataggtccaacccgtcttggaagattttaaatgacatacaaaatatctctgcccattctcttttataatttgatatcctttttcatctttcaggttgggaatccgcttcatcatatgctcctggttttcatagatcacgccctcatccgagtaaacacagagagccgaactctctgcttccagatcgtcgatattcttctcaatcattccagatacatcacacgtaatcagtaaactcccaagatactccaagcttgcatcaatatgttttctgatgtcccgtcctgtcagcaaatatgggtactctgccatcggctgctgcacgacataggcccctttcgcttcatgaattctgttcatcacagagttatacagttccttactgatcgttccggtcgcaattcccacaacaaactgtgttttatctccatccgtatataccatattggaaatcatattagaattcgtcagctcgttattaaacagcatccggagctgataaacctcataagaatagtccgcggtaaaacgttttaagcttttcattttagaaagctgttcctgtatttttgtatccaatgctatattataggagattccctccacctcatctaaactccggttaacctcctgaataaaaaaatccagttcctgcagagatttttcatataatttcccatcatatatattaaagctgacctgtagtgccacaacacttataaggaaacagatccccagcatcatgacgtaaacgataatcattttttcggccagtttcaaatcgctgtatttccggtaccagtatccccgatattttttcatcgaacgcctccttttttaatacagtaccgttttatttgcaagtataattcttttccccaaaaattagaatgtaattttcctgtattctgtatgaaaaataccgacttaatcctcctgatcatccccggcatttttactatatacagtataaggcaaaatattataaccggcaacagattaacctgtaaaggaacctgttgccggttattttagtttccattagtataggttattacaaaatttaccagaatctttttccttcattgcctggtacagttcttcatccgttaagtgattctcatagtttaacaggagcataatttttctgtccctttccggatagatcacctgcctctgccactgataaaaatatggcccgtcccccagattccttatgtatcccattaaaagcttaagaaggtacgccgtctcctttacgtctgtctgacagtcattatcataaaacccgttccatttatcgtgggagcattccttcatggcctcatccgcctgcccgaagcagtctgccgcctggccgatttcgtaaaatgccttgtaataatcattcttttcataagcggaatatcccctgccaaaatgggtcaccccctccaggcagtacgtgtgaatttttacctgaagaagaatggaatccgtccagagcatgccgttgtcatcgttcagtctgctgaccagaccggcgcatacatccagaaggctcttaaagccaggatacccgttttcgcattttgatacaaaccactgaagctgtgcggaaaagttttctgcggggccacaccaccggagttcctcacaggccgcttttcctccatccttcatccactgatggatcaaaactctggtgacataattataaaactgttcgcctgcgtgttcatcctccttctccccataaggaaccgcagcctcaaaatattttagaaagcagtccttcatttcctccaaagcttcatttccgtaatagtttctcaagtactgttccagatgtgtttcaggttctgtttccagggagttccataaagaggcagtaaaatccagcgggtaaacatggggcttaatattagagcagtttacgagccacagtgttgtaatgccgcaattgtatgcgttttcaagctctttttttacaaattccatgttattaggaagcatggtgagcacattggcggcctgaagatcatagaaagacacatgatagtatactccatgctttctgtctctcaatccttcaccgggaagcgccggaacccttgggttatggtttccctgtcttctggacaccattttcccgtaaccgttatcggcccagatcatgataacattctccggcagttctatgaagccctgctggtacagctccatagtttctccatacagattcgtgccaaaaacgggatcgtcaacatattttttaaccatatcatactgttcctgcatgatgctgctgatcagacgccctctcttttccggggtgtcatattggggatcgttctcccagaaaggagcatctccctgaccccgaaaaccaagattccagatgatcttatggttcatctgtcttttaattccttcctcccaaagtcctcggaataaatctggatactctttgtaggaaggatttttatccggataggcccgcagaaacatctccgcccccagcggctccgcatgatgctgggtaatccacagccccatatctcccgccaaaccggcatattttttcgaattcctgtctgttcccggtattaccgtgttgccgccgcagcgcagcagcgcttcaaatgccatttcccatggatattccgcattttcttttgcagcccagcgactgattaaaacctcatcattgataaaccagcctctgtaggcaaccggccttttctctgaatggtattccataaatggaaccgggattcctttctgttttacaaacttctggtcattccagaaccagaatggaagaattcccaggcagtgttcgctgatataaagcagcgcgtaaataaagcccagctcctccgaggccgaaacaatcagcttcctgttattttccacatgaatctgaaattcttctgctgcagcgcttcctttttccaaatatatttttcccggaccatccttctccaggccctcctctttcggttctaataccattgcaagatccctgtagaaccgcatgaccgcccgccgtaccggttcacttttaatttcagtatctataatcacattaccggtcagtataaaaaaatctttctgcatatttgcaaactcctcttcctcttaagatttatatcttaattttaatccttccctcttataaaacaaatgactttttcctatattattattggaaaaaaacgactttcttacaaattaccgctgccagacccagaaggaggagatcgttaactcaatcatttctcaatatttaacctaataaagtctgtttttttcaaataagctcccggtataatccattctttttttcaaaaaacgtcaaacggaagctatcaccgaaaaaagcacccgtacaaaaaggaggaaattatcatggaacataaatttataacgtttcagactacacagcagattatccggtttgttaatctggtaagtaagctggattttgatgtggaggtcaaatatggaagccgcattgttgatgcaaaatcaattctgggactactttccctggcctcgttcaaggctgtgaaagtagtctttcataccgtcgcttattgtaatccgcggttagataagctgtttgcaccagcttcatgattgtcgtcaaataccggccttttaaagcaaggcgcagaagaaaaaatcaaagagcccgttaaatgtcaataccgttaaaagggacaatgatgtcaaacaggttcttatctcttcaattcctcatcacaaatctaaatcgaatgagacggagcataagtaattgcctcatattttagcgcataataaagcgcccactcctgatcttttgcccataaatcataaaactttccctctactccattcacagtccgtggaaataccatggcgcaggatgccctgccttcttttgtaagcaggtttaatcttgttatgcatagtaattatcacacaatgacttccagaaaactgtaattggagcggatggcatcctgaagctgtctcatgaaaatggctatctttccatgataaatcagggcgtctcgtacgggtcaattaacaggaactggttttcatgaatgcaataagagacgcctctgtatctttgcaggacaagtgctggggtagtactgcaacaattgaaaatttcacaaaggagttctttgaacagaatccggaaatggcagctaagtatgaagtggaatgggtcgtgtaaggaaaaggtgacaacgatatgacagagagagtccgtctggcctaatacgcagccaggatgagactacaatgcactttgcggaagcggttctatttatttattacaagaaatacatacttacctgaaaagaaccgtttcccagtgtgtcataggacatacagatattttcatagatataagttagttgatttagagggagggagcgaatgaaaaagaattgtattcaaaatatcataatccatgtttctgacaatatggattctcactccctctcggataaaataaatgaattccatgtagaagtaatagaacgtaggttatgtaattctaatttatcggttaaagaaaaaatagccgttattgacagaatactggaaaacctaaaatcacgggagcatgagggaatcatcaaataagtgtttgtaaagccgccatatatgataaggcggctttacctgtttttgttcccagctgcgaagcgtaacgtgttttactcccataaaccgtgccagttcctgctgtgtaataaattcttttttcggtaagctttcattctatctgcgcaatcgtcaaggctataaactggtattgctaatttggctgtttcttccttgtcagctccaaggaacagttttgtttccctttgtatggttgcggaaaacgtccgttgcatggcacaaaattatttgtgatcatggcaatcagccgttctctaggggagtcgatgatccggcagccgataattccggcagcattgcatccaaaccccatgcacatgacagcggaaatttatgccctatcatccctttcttctgacggagccagaatcctgtaatagatccggatggtctggcatttattaccttttctctcttcttcgcagctttggaaaatctcaattctgtctatgaacgttcccagcaaatcagaggaaagaccattttccttgcttaattcccccaacaacttagaaaacaggcaggaagcgtcagaccctcctttctggtccaaagggcatggtttttggagcagggccaggctgtccctgatatctttttcttccttttcaaagaagtccagcattttataaaaccgttcttccccgatccgttcatttacccggtcttcgtagagctttccgatcatgcattcaagctccctctctctccttatgagttgggactccgcctttttttcgccggacatttcttcagggatgcaaagttcccgaagcactgcgtcaatttctgccttttcctcttccgtgaaggaaagaagacttcgtatttcttccaatatcaccttataaagaagctcgtattccatgaaatgattggtgcattctctttttccatacagcttataccctccgcataccagcttgggggatcccctttttcctcctgctccagtgaaggacatgttcctgccgcagtccccgcacctggcaagcccggagaatacgttggcaaaacctgtttccgcaacctttttacggggaacactccgtctccttacccgttcaaaaacctccagagaaatgatcggctcatgcatattctcaaccaccacccactcttttctgggttttcgaagggtcatgctgcttttaaaggaaacctttaccgtctttccctggacaatgtggcctatatatacaggattgcttaacagcttgcagaccgtgcctgatgaccattccttccttatggaataaacatcaggattgaggtaaggccgcccggcacagcggtacatggccggagtcagcacgtttctctgatttaaaagctgggagatccgggaagggggttccccttcctctgccagccgaaaaatttcctttacaatggaagctgcaacagggtcaacaagaaggtggtttttatcctccgggtccttctgatagccataaggagcaaaattcccgataaatgctccctcttttattttagtctgaaaggcactgcggatcttttttgaagtatccctggcgtacatttcgtttatgatgttcttaaagggtgcaatatcgctccacggactgtcagaatcatacccgtcgttgattgctatgtagcggattcctctggaaggaaaatagatttccgtcagctgtcctgtcatgatataatcccgcccaaggcgggataaatccttggtgatcactaagttcacctgtttttcttctatatcctgtaacagctgtttccaggccgggcggtcaaaattggttccgctgtatccgtcatccacatactccctgtatatgtcaaaaccattttccatggcataggagcgaagcattttgcgctgggtgctgatgctggaactttcccctgcaccatcatcatcctttgacagacgcatgtaaagtgccgctctgcagcggtccggctggctgccagatccaggcccggtcataagggaagcgctcctgttttacaccgtattttgaaaaatcccggaatcagcgtttctaccctttcttcttttgaaaagatacgccctgcctttgtaacggaatacttttcctcataggctgcctgatttgataaatccatctcatacacctcctgaaaaatcatattccagcaggtttgtaccatatacttcagaggatttttccggttactcagccaatcattgataccggatagaaatctctgatccattttgattaaagtaaatacaatctcccttttcataatgccagacagcctgaatggctttcggctgtaagattccgtttacggagtgataatcacggaaataagccgaccagtccgcttctgtttcatttccctccatgtcaacggccactctgtctccggtacggaaagagagcaattttccggaagcatcaaaagtaaagacaccctctgcgtttatcccttcccatgttatgcttgctctcacgttggtatcatccattggctcccattttacgaagtcctgcaatgcggcgcctggcaccattaagcattcggccagccaggttacaagacaggcacggtccatgttttctccccgttggtcaaataaaggaatgacctttgcaagcatccccctcatactgcctttaccgttttcataagagtcaagcccttcaaagggaatacctgacagggaggaggaaatcagtgcaaaccgttccggtttttccataaggttatattgtttataatcaatttttatggtttttgtatctgacataacaaaatccacatggtttaattcagccttcatgtatgccattttaggggttccaagaaacccgcaatgcctgaaatactgctgtaccggccttggcaatccctctatgtccccctctgtaaagatttctgctgtatgatcggctcctttggtttttatctccgtaatgcgttcaaaactggctttggccggtgaaaaaggaagcaataaaaatatcacgattcccaaaatcaataaaatgattaccgttatcccaatcatccctctatgccttcctttcgtcatattttaatcccatctcatttacatttccttccagccgctgaaacatttcagataaaaaggatatgtcttccggtctgaagttctcaaacagttcctcaatgaagcggtcctccatctcttcccgctgctttaaatattcaacgcaggcatcggtgagattgatgcggaccactctcccatcttccggatccttctccatcagaacaaagccttgtttttccagaagagacgcaattttcttaacattctggcgcgagcttccgattttcgcccccaattcagaaagcgtgggagtattgctttcgcatctcaatacaccggcaagaaaaaaccactgcttgactgtcaggcaaggatccattttgtctccaagaatctgcagcttgtttgacagcaagaagatcatgccaaacacatacgccttgttttccatatcattcatctcaatgaccgcccttcaacatataagtaaccaacaaaaaacagtaactggttacctatattataagtaaccagttaccctttgtcaatatgcatgggataccacaatttgattattgatgcaaacagatcctcaaacagttattgatcagcttttttccgtgtaaggccctcacggtattcattgggagaaacgcccgttatccgtttaaactgggtgtaaaaggccgaaaggctctcaaagccgctttgtaaagcaatgggcaagatattgtccggcgtactggcaaggagttccctggccttgtttacccgtaagccgtttaaatactccaccggagtcttttcatattgattctggaataactgtatgatcctgtttctgctgagcccaagcttttttaattcctccattaagcggctgtggtcagtaaaataaagatcataaactgctttaattttttccccattctctttctgcggctgaaattccagcaaatcgggacggcagcgcttacaggggcgaaggccgctttcacgggcctgctccgccgtatcaaagaactcaacattctcccgtttaggacttttggatttgcaggaagggcggcagaaaatacccgtagtttttactccgtaatagaagctgccgtcataagcctcatcacaggccagagccgccttccacttctcctcttctgtcagcatattgacatacctcctcttcctttgtttttattttctccttccagttcagctgctccgcaaaaaggaagtctccacaaataaatggaggccaccgagccatagggggaataccgttctctgcacatctcaaactggctctttgtcagcttcggaaagccatataatttttccatgccccggcgaatggccatatcgccccaactgaccacatcgggacgttccagacagttgatgagcagcatttccgcagtccaaagccccaccccttttatggccgtcagacggcggatgacctcctggtccggcaattcccgcaaatcgtcaaaccatacctttccctgtaaaatatcttttgacagatctgagatggtaaccgcctttttcatggtcataccgcagcgctgaatgtcatcaggggaaacagccgacaggttttcagcagtgatatcccccagcctttcctgtacacggccccatacggtattggcggaggctgcagataccagctgacctataacagcgtacaccagcgctgcaaacggatcaggaattacctgacgttctacccgtcccagccgtgtcatcgccgccccaagcacaggatcggctgaggaaagatactccacttccgttctgccgtagtcaaataattttatctcaacggccggcatgtgtccgctccagctccaataattgttctttgacctccaaaccggctgcataacctgtcagtttgccgtctgagccgattacccgatgacacggtgtcaggatcaaaatcggatttttataatttgccattcccacggcgcgggatgcgtccgggcgcccgatcatttccgcaacctgcttataacttctcgtttctccatatggaattctgcccagggcttcccatacggctctttgaaattccgtcccctggacggcaagaggcagatcaaatgccctgctcgtcccagacagatatcctctgatctgcttttccgccttctccagcaaaggggttttctgaccgcccaagggttcacgggcatcttttgcaaaaaacaattccgtgataaacccattcatttcagatattcccatcagtcccagcgtggttttaatgaatgccgtatgtttcataagactcgcctccttcttataatcctaatatatacgaaaccgttccgcgtgtcttcctattttgcaccatttaatttttatataaaaatagtttttacgctgcacggttgttttaaaagaaaatcctgaaacaaaccaccttcttccgcacaaatttaacggaaattccatcttcttaccaatgtcagaaaagaacagggctgaaataatgtatttttataaacaaaaagaccatcatccctatggattccggcccttttgcatcattgataaaattctcccatatctcttttcccttttatcctgacggattctttcccttgtatttagaataaatcttcctgaaatattcataattcggataccctaccatctgggcaacctgatacaatttgaactttctgctggcaatcagggcgtctgcctgctccaggcgtatggttgtctgatattccctgaccccgatgcccagattttttttaaaaagcgttcccagataattaggggaaatgtaaaacctgtcagccagctcatttaaggtaatatcgtctgtataattttcactgatatactttgacacctctttgcagagattggcgttttttccccctcctctgctctcctgcaaaagttctgactttacaaaggatatgacggcttcctttcccccttgataatctcctgcttttaagggttcataaagattagccacggtcctggaggcaatgccatggcgcataaaatagattcccaggctgtaaaccagacgcttcataagcctcagacggtactttgcttcggttttatcaatcttcagcatccagttctttaaactccacagcacaatctgctgatccctgtcctcaactgctgcctttaacacagtatcattgccaagggttctgtataagtgctggactgaggcgggcatatccagggaaaacaggctttccagagaagtttcgtacgcctttcggatcatgccaaactccttatatatcctgatcttggaacaaagcagctcctttccggtctgttttctgagtttccgtcttaaatcttccatggctgcatcgatctccgcctcatcagaacctgaaaacacaaaggaaaaggaaaactggttttcaagcagccgcagcctgtatttgcggacttcctccaattcccttgccagctcatttaagcatgcgattccctgcacctcttcttctgagggcggctgctcttcaaccgtactccttaatgccaccgataccacggaaaaggaacagcccctttcccgttccacaaactccgcgtaaagctccagcagtttgtcatataaagacctgtttccgctcatgatgctgttataaaccgcatctttaaaaaccttcattccagccatgaccagctctgcatccgctttctgtttctcatcgtttatccgccgttcatccagccgtttcttgatccttataaatacttctatgatctgttccggagcagagggttttaagacataatccaccgctcctaatcgaagagaagactgggcaagctcaaagtcatcataaccgctgagaaacaccacttctatctgactgaacccggcctccctcagttcccgcaccagggaaatgccatcctgaatgggcatcttgatatcagtaagtatggcctcaggcggctggtttttcatggcttccccggcttcccttccattggtatatgtcccaacaatccgaaatcctatttcctcccatttgatggcgttctgtatccccgctaaaatccagtcctcatcatccaccaaaaccagattgtacaacatagatgtcccctccttgttgtaattatgtctgctgattcggtacttcatttaaaattttaatctcaatggccgtgccgattcccactgtggattgaatggtgagcccgcacccctccccatagtaaaggccaatccgtttcatcacatttttcagtccatgtcccacgtcggatttcatatcataaacagcctctacaagctccgcttccatgccgcatccatcatcagtaaccgtaaaataaatatagtcttcttctgcaaatgccttcacccatatctgcccggcacctccccggaaatcaaagccatgaaggatggaattctccaccaagggctgaaggagaagcttgatcatacggaattttaacacctgggaatccgcatccagggaaaactcgatttttcccttgcagcggatattctggatgtccatgtagctctttaaatggttcagctcatcacttacaaaatacacattcttccccttatttaggctgagccttaagaaattccccaaaagaatcaccatattgctgatttccttctgtttcatgctgagggccatccagttaatggcctccagggtattgtataaaaagtgggggttgatctgagcctgaaggatttccagctcttttttctgtttcaatttttcctgctttaacaggctttttatcagatcgtcgatctgtgtggtcatatggtcaaactcagtgcacagcacatcaatttcataaatcctgctgctctttcctgtccttaagccccagcccctgcccttaaaattggtgacttctttggacagcatcagaatgggttttgatatcttataagccaacagtgcgctgaacgccacaaacaggcagagaaggccaatggaagatacaaataccattttctgggtctgcttaaatgccgccacggttttgtcatagtcggtcactgccatgacataatacttgtgttctttcagctgctttttgttaaaaatcttaagcccggactcaatatccgggttctgttttcctgttaaaatcttctggtatttatcatagactgtttccggcaggcgctttccgatcacgcttctgtcggtgctgcttatgatgttgtcctggtcatcaataaacaggattattgattcctcatcctggcagtattccttcatctgattataaaacaggttttcattgagattaatgacaaggtgtccgattccctctccatagtaaagccctgaataaatcctcatgacgtaagtattgatatatggagtatgtacctggtttaacaagtcgttttcccgggtggtaatccagcctgaggacatattctgtattctctcacagctttcttcaccagtataattttcatagtggtaaacgccgttgattctggttgttttcagcgcatcatcctccatcaggatattcacggacacaatatcccccatggtataagccagagaagaaagattctggttcatattgttctgaaataccatctgttcgtaggaactgctgtttttcttatagtttaagatgttattgatgatattataattgttggccgttgacctggccagcagctcaatggaattcatgcttttatccagagtatcgctgatatagaccagcatctggtactgcttcacctcaaattcctgatctaaaaccttctgatagcttttctggctgaaaaatgaactgatacagaaaaaagccgccataatcagacagttgctgagtatcagtaatttgctgatggaaattttaaacacctgtcctttcatggcagtctccctccggatcaaaaggttttttatccagcttgggccgctgcaaaataaactataattcagtcactttacagcagccctgtattcatttattatatcatgttttataaatccgtactatctcccttattttgaattattcaccgattcagaaataatcttaaaggcattggcagctgcctcaaggggtgttttctgtccgtatcctgtggcatactgctcatccataatggtgttttcgatcaccgcgcttcctggcaccagccattcataatcaatccgctttgtgttctccaccaataggttcaccccatccactaccagcagcgcatctccttccagcattggagagatgatttcacggatggattccggggccggcactccgcggacagtcatgagtatcttggccgcttctttgtcattaatcaggaaatcgatcagggttgccgcttcctccggatgcttggagccctttcccagagtccatggcatagaagccagcatgtaggctccgccgttctgagctgtgcccggcactaaggagacgcccaattctgcttcttctgccatggccgcatggtcctgaggcatggttgcaatatggtttacttcacaggccgcatcacagcttaaaaacagattgtcctgctgggattcctggcccacggttaagtccagaggcggaaatactcctgtttccctccatttattatactgctcataagctccggaaagagcctctgtaaagtctaaaagctcaccttcttctgtggcaaaccactgcccagcctgtcttaccatggtcatggtaaggaagtaggagggctccttcattccatattttccggtcttgtcatagatttcctgacaggccttttcaaaatcctcccaggaccaatcgtttgtgggataggccacgcctgcttcgtcaaatatctttttgttccagataaagaggggaccgttaagtccgctgggcaccccgtattggactccattataacgggcccatgtcaacgcgctttccggataatcgtccaggttcagctgttttccgatgtatggggtcaaatcacccaatttgtcattggctgcaaggctggcaaaatacacattgttgtccagctggtacacatccggctctgttccggatgaaatctgggtcatcagcttatcgtggtagccatcccagccctgatattccgcggtgaccttaattcctggatgcttctccataaataaatccagggcttttaaggttgcctcatgcctggcatcgcttccccaccaggatatacgaagctccaccggtttcccgtcccctgctttttccgtttcagcaccggaagtatctgcgccttttgtatccgcgcctgatgagtttgcctgcgcatttggtgcggcggttcctcccccaccggaactgcacgccgccagcatgaaagcagtacctgctgctaccactgctgtctgtaacctggacatttttttcatttttgcttcctcctttttattatttgcaatgaattctgaacgttttgatctcataaggatttattataaatgatatcttttgctccgcaaccggcacatctgccatgtgcctttccagcagatctgtttcctcacatgcttccaccggaaaattgaagtaaatccttgcctcacttaccgtattataggtttcaaaaattcggatgacaatgtcttctccgtcttctgatctcttaactgtgtcaatgatgatgttgtcacaatccgtatacaggtaagacctttcctttgccttcttctttccttctgttatgatcagcggaacattcacctcataaccggtctgtgccaccttcccctctttgacaccgcccctgtggggataaatccagtaagaaaagctgtggatgcctttatcacaggtttcggaaggatggtcagcgcctcttaacaggctcagctccatattggaattctgaatggaataaccatatttgcagtcattcagcaatgatacaccaaagccgccgtcggaaacatctccccatttatgtccgcacacctcaaatctggcttcatcctggctggtggtggaatgatttggatgctctgcattgccgaatgccacatcatatctgacgttcagcgcatggacagccacaggaaattccacccggagcatcttatgtttttcatcccagtcaacctctgttttaaattccatataaggtccatgatggtacacgatgatctcctgctttattctggaatgatgaacctgggattctatggaaaccactgtgtagagacaatgatgctctgtcaccttttgacttacaatatggaagggcagggaaggcttatcctcccgttttctggtggtctcccacgccgatccccattccaccggaatatcctctaaaagctttaaaagatttcctcttttgccttcttttaatacttggcggcgggcagttttatcatataaggatatcagggttccttcgctatccagctccagatccagccactcattgcttatttttatgctgttttcccctgcttcccagaatgcagccatgggttcacagctctcctgtccctcatccgtccgttcataagtccggtatcccaaagccggcacatcttccgccaggaacacaatggttccatccgcttttttaaactgcctagggcagtttccgtttaaatccttaaccccctgttttccctgtccgtctatggataccacctggctccggctccatgacagagaattataaacagtcaccccttcttccggcaaacaggccatggaatccagattctgacggatgctttgctgtccgatccggcttatttcctcataatcccggtcacattcctcgtaaacctcaccgatgcaggtgcctggcagaatgtcatggaactggttcagcaaaataagtttccagcctttttccagatccgttccctgaaaccttccgttttccaggtactggaatacggaaacgatttccgcatcccggaataaaaattcactctttctgttgttcttcttattttttgccgcagttgtataggtgcctctgtgtttttcaaagtacagctctccggcccatacaggataatccttttctctatccagttcctcaaaatactgctttacggttccaatttccacattaggcgtcatgggaactttctgaagccttgtgactgcttccagcatctcttttgttacgccgccgccaccgtctccatgtccatagaggtaaaggagcgggtcgccgtttcctttattcttgaaatggtccatggataaccggacgccggaggcagacaaatccccattgtaaagacccagacctttttccgaacacatggacatcataccggataagatttctgttccatccaatcctctccacttaaatacactgtaagggaactcattggtttcattccaggtaagcttcgttgtgaagaaataatcggtgcccgctttctttaaaatctgaggcatggcagaggaatatccaaatacatcaggaaggaaacagatattggaatcagagccaagctcctggttgtagaattttttcccgtacataatctgcctgacaaaggattccccgttgattaagttgcagtcaggctctaaatacatacttcccagggtctcccatctgccttcctccaccctttttttcacctggtcatacaattccggataatatttcttagccatttcataaagcacaggcatgctctggcagaatttgaaatcctcatactgttccatcagtctcagcatgctggaaaatgtccggcttacctttctgacagtttcctttaacggccagtgccatgccacatcaatgtggaatgtcccgcaaaaagcatattcacaggcatttttaagtctttatagtcagaaattccttccagataggcagccatggcctttgaaaggctggccaaaagagcttcctcatcggaataatccagcttcagcagagaatcatacagcacatgaagggtgcgctgccttgtatactcctccgcacatcccaatatgaattcaaaacccgtttttatctcaaagtaatactcccaaactggccggttgatggctgctatttcggactgggtgatgacaacatcacttttaaacacattgctgctgtctaaaatcaagtccttacagtaggtttcaatttccagctcatattcctcgccgcctttggcacaggggcttagcatgaccatattccggttgaagtcaaggccgttatagtgctttccattgacagagatacagccctcgcctcccaccttcagtaacagcaccgccgtatgcccttcatagctttgatccagggccactccgttctttaagaatactgtgtaatcctttcccccaatatgttctccttctgaaagagaaaaccactcctcatcaagcatttcatactggccaggccccttgtaaaacccccgttttgccttccagccgcaaaacggcgccctgtgataatacaacagcccctccaggcggtttaattctgactgaatctttttctcaatctttaacataaaatccccctccttttatcctttcagacctgacgtgctgactccatctacaaaatatttctgcatacagaaaaacatcacgatggcaggtaatactgaacataacgccatggccatcactgcgccccagttatccgcgccggtggcatcaatggtggttctcattgccagcgcaaccgtatataaatcaaccttggtaagataaatcagctggttctggaaatcatcccaattccacataaatgaaaagatggcaacggaaaacagggatggcttgcaaaggggaaatatgattctcagtataatgcccaaggcagagcagccatcgattttcgccgcctcatccagttccttgggaattccgcgtatgaactgggcgacaagatagatgaaaaatccgcctccatttccaacgcccagggcggctggaatgataaatggcagataggtgttcagccatccgatcttgctgaaaataacatacttagataccagggtggccgtagccggcagcatgatggttaagaataacacactgtaccaaaatgtcttgaatcgaaaattcactctggcaaacgcataacccacgaacaggctgataattaggctgcagataacacaggtgatgaccaggacaaaggtattaataaagaatttatcaaaggtatacggtctgaccagtttccagcccgccgggaagttgtcaaaccgaaactcgcttggaaacaggctggggcttgacagcacttctttcgatggcttcaatgccgcaaatatcatccagatcaggggatacagcatcacaagtcccagaaggctgattaagagatagatgacaatgctgcttatggtttttttccctttcacgttccttcctccttaatcgtcgaaattcagaaatttcttctccaaaagatgcagtatcagcgccgttcctgcaatcatgattaacagggcccaggataaggaggaagcatatcccacattgaaatacttaaaggcattctggtatagatagattacataaagcatacaggagtttaaaggtcctccctttccattaaatatggtatatggcgcggcaaacatctggaacgcgttgatggtctgcatcaggatattaaatgacatcattggcatgatacctgggattgtgatgctgataaacttggcaacttttcccgctccatccacgctggccgcttcataaagggatgagggtatctgctttaagccggctaaaaataccaccatagaggacccgaactgccagaccgtcagcagcgaaatggtaaacagggtgtacttgggattgccaagccatgataccccttcgattcctatttccgacagcagcgcattgatcacaccgtcttttacaaaaagggccttccacagaatcgcaacagcaatactggagcctaagatcgacgggatataataaatcgtccggaagatgccgatacccttgatcttcatattcagtatcatggcaatacacagtgcaaagacgattttagccggtactgcaataaacacatatttgaaggtcacctttacagcctggtaaaacacctcatcctcaaacatcttctgataatttcccataccaataaatgccggcgtattcagaagattgtaattggtaaaggacatcagaaagctatgtaatatgggccatagctgaaaacataaaatccccgcaagccagggtgcaatcagggtgtaaccaattaagttttccctggatttaatcctttttttgctcatgtacctttatccccctcttgtttcgtctgtaattatcttattggaaatccctccttttctcaacgtaacaaaactacagtttttcttcttttttaacaattcttccagtttttttctctattttaactttttcatgtgcatatagcacaaccttggtttactcactccagggtatgtaatatcaatagtataacaggcacaaaatcctctgaatttatccaatatttaccatattttggcagtacagtaaaccggcgtccttttcctttcaattcacaggcggaatcaatcttcagtttttccgtccggattgtaaaattcgtggactactgaatcccaatcatcttacagcccggaccgatggcatgagacactccgtctcttaccagatagtttccccttcctccaccttgatgcgtttttgaatgggcagcatacggtcataatcctgggtctcgaagcaggaaatcaagtcatgcttcttgattccagtcctaactcccagacagaattttgctcaaattgagtataaaaaaagggcttaaccagttcccctccttaattgaggggctgattaagtcctgtttcatcgccgtcacacacatacttccagtaactttcaaagccgctatccaggtcataggtgcaaagcatattgagccgggtaccggagcggtcatgtccgacaccgttcatggcaaagctccccggcctcccaacgttttctcaataattccaataccagctcctttgctgtcttttcaccgataaaaacccgctccacctttacggtcatatttttttcctcataggttacctgatctgatgaatccatttcatgcacctcctgagaaatattattcaaacgtgtttgtaccatataccgtaacacatgcatgtactgtttatattttaggaaagactcaggaaataaaaaaggtatggcagccgctctgccataccttttttctactcttttcatcactccatatatccgcccttcattggagataccgcacgttcactgaatattttcaatactcctgacgaatattttgacggtctaggctgccatctttcccgccgttccttaaggatctcttccatctcacgttctgatttcctctgaccatttacgcccacgatcgcaagaaggcggttaggtatgtctatttgtatcatatccccctcctctaccagcgcaatggggccgccatccgccgcttccggtgaaacatgaccgatagaaggacctgtggaagccccggaaaaacgtccgtctgtgatcagggcaatggtgtgtccaagctccttatctgacgagatggcctcagaggtgtaaaacatttccggcattccgcttcctttgggaccttcataccggataaatacggcatccccaggctttacccggtgtttcagcaccgcatcaatggcctcttcctcactgtcaaaggggcgtgcatttaacaccgcctggaacatctcttttggacaggcagtatgcttgatgaccgcaccttccggcgcaagatttccctttaaaatggcaatggccccatctgttcctatcgcctcctcaaagggacggattatttcttcttttttcaccccggcttttacgcaatactcatcgcatttttcataaaaaccgctttgcttcagcatctccagattttcacccagggtctttcctgtcacagtcattgcgtccaaatgaagcactgacttgatctcttccatgatccttggcactccgcctgcatagtagaagtactgggccggccatttaccggcgggtctgatgtcaagaaggtaatgggcgcctctgtgcagcctgtcaaacatttcagaatctatttccaaaccgaattcatgagcaatggcaggaagatgtatcagggaattcgtggacccggatatggcggcatggaccataatggcattctcaaaggattccatggtaaccatgtctctcggcttaattccctttgcagcaagctccatgatctggcggcctgctttttcagcaacctcctttaaatcaggacaggttgccggcataagggctgatcctggaagcatgagcccaagggcctctcccatgacctgcatggttgacgccgtacccataaaggaacaggctccgcaggatggacaggcatgctgcttataatattccagcttttcaggctccagttcccctctctggcacatggcactgtactttccgatctgctccagggtaagaagatccggacctgcatccataacaccgccggtcaccagaatggaaggcatattaacccggccgattgccatcaaatgggcaggaacccctttatcgcagcttgaaacaaatatcccgccgtcaaatggagttgcgcccgcgtggatttcaatcatattgcagatcgtatcccttgaaaccagggaatagttgatgccgtcatgcccctgggccattccatcacaaatatctgttgtaaaatatcttgccgcttttcctccttcttccttcaccccatctgccgtcctgttcaccaattccagcaggtgagcgcttcccggatggctgtcaccaaaggtgctttccaccatgatctgcattttggaaaggtcttctgccttccagcccatgcccatccgaagcgggtccatttccggagccagctttcgaatctcctgactaaccataataacgctcctttcatattcatcttatattttatattttcattataataactcatcagatgattgtcaattacactttatggctttattttaaattcctgcgtatccttcacacttattatacatttcgccttatttattttgtttttcattccaaagtcatctgctcaatttatcatttcatattcaattcatctgatttattaacacatcatctaatttatttatacttgaaggaatcagaaattacgtttataatcagatgagataaccacatagctgaaaggaacacactatggcctcaactcataaatcccttgccgatacaacggctgaaagaatcatcaaatacatcattgacaacaaattaaaagaaggtgcccagcttcctaacgaaaccaccctttcctctcttatgggtgtgggacgaagtacccttcgggaagccgtacgggctcttgtttcacgcaatattcttacagttcagcagggctctggaatttacgtctgccacaatacaggcgtatctgatgatcctctgggcttcatttttattgaaaataaggaaaagctggtagccgaccttttggaattccgcatgatgatcgagccccgggtggctgccctggccgcctcaaaagccactccgtcacaggccggggaactgcttttcctggcaaaccgggtggaggaatgctaccatgaagggatatcccacacagagaccgatgccgccttccatgccaagatcgcggagatcagcgaaaatgtcatcgtccccagcttgaaccccttatcatgcatgccattgacatgtttatcgacatcacccattctgcattaaaagaggaaaccataaggacacatagggccattgcaaatgccatacaaaaaaacgattccattgccgcccaggatgccatgacccttcatctcatttacaaccgggaccgtctgcgcaaggttcttgaaaaagatcctgcctaaaaattccgcccataaaaagagcattccaaaggtcccttcgcaccattggaatgctctttattatttttcacttacaaataatgccggattatttccgctcccccttcatggtctgctcaatgatgctgcgcatggtgtcttcggaaagctggccgcttgcataaccaaatacatttccatcccggtcaatcataaacgtggtgggataagagtagattccgtaagcagtaaacagttctgcatctgtatccatcagcacagggtacgtatatccgttttcttccaggaactttttaatcccttcctcatctgtttcccttccataatcaggggccgctactcccaaaacgatcagtgcatcgtcgccttccgtattggcagtttcatatattttctgaatatccggcatctccgccctgcagggaggacaccaggttgcccagaaatttaaaaagatcgtctttcctttataatcggaaagggaatgggtattgccgaactggtccgtcaatgtgaagtctaccgcaggcagcggctgatttgtgtcgtctgactcctcagtcttttccggctctgatgcggattcttcttccgccggttctgaggtttctgctgattctgtggcttctgctgtctccggcgtctcttttgattctgtgactgtgggagacggtatggaggaaagatatcctgtcaccgcattcatttttccggtaaacattaaaattcccataaaaaccatgagaactccgccgacttttactgcattctttgccagatttccgtgagccttaaaaaactcaagcaccgaggtggtgaagaatcccactgccaggaaaggaaggacaaagcccagtgtgtacacaccaatcaggacaaagcccatggcctttgtagaggccgaggcggccataagaagcacgctggcaagggccggtcccacacagggcgtccaggcaaagctgaaggtaaatcccataatcagtgcagttaagggagacatggccagtgtattaagagaaaatggcagcctgcgctctcttcccagaaccgaagaagtgccaaaagtgcccagctggtataaaccaaacaaaaccaccaggattccccccactcttgcaaagagaagctggtttgatttaaaaaaactgccaagagcagaaaatcccagccccagcagaaagaatgcaaagctgactccaacaacaaagcaaacggtatgaagcatgaccttgctgcgtttataataaatccgcccgtcttcccccggactcccgttcctcctgacaaataccctatgtaaagggggatgaggggagcacacaaggagaaaagaagctgattaccccctgaagaaacacggtcaaaacaggaatactcacatcaattgaaaatcccaaatactgtacctccttttaagcttgcgccatatcttaccggctttttgcatttttctgcaactattctgtactatttttagttacagtttataggtgtaactataccatttccttgaaaaagtgtcaagtcaattattgtaaaataaaaaaagcatagatttcttctgtcacatggtaagcgcctgctttccgcaggctgaacaccgcttaaagcagcggtccaagttaaatgccactctgggaaggtatccaaaatcctctaaaagcgtgaacagagggaaaaagatcgccataggaggaagcataactgataccacccaggccaggacccggtaaacaccatggatcagcagatctgatataatggccggcaccccggcagcatcggccaggccgctcatccacgcctccactttaaacagcacgttgctcagcatttccgaaggataattggctcccgttatggtgagccagaaggttccaagcaaaatcaggaacatgatgggaaaacccgtggccttactggtaaaaagctgatccagcttccggtccttcctgtcataggtctggttttcatattccaccacaccttcgcataaagattccgccttttttatgaaaacagcagccatgtcatcgcttaccttttcctgggagatcccggcgtccttccattcctcccggatttcggccaggcaggcagccacttcttccgattcagccacaggctttctgtatttccttacggcctccattaaatttccgttggcgtccagcagtctggcacacagccaccggacctctgtctctccctcagccgcatgttccaccgacgggagaagcctggcaatggcctcttcaatatattgggggtaacggatgagaacaggtctttcctctggcccagtctgttccccttcttctttttgttccaggcagcgctttaagccggtgtaaatctgatccagtcccttgttgctcctggctgccgttcccacaacagggacaccaaggcgctgttccagtatgtcaaggcgtatataaatctttttctttttggcctcatccataaggtttacacaaaccactgcctttggtgctgcctccatgatctgcagcaccagatttaagtttctttccagacacgtggcgtcacagaccaccactactgcatccgggttttcaaagcagataaaatctctggcaacctcttcttccgtggaatgggccatcagggaatagcagcccggaatatccaccatcacgtatccctgactgttgtccgtacaccagccctgggcattggctacggttttccccggccaatttccggtatgctggttcagcccggtaagctggttaaataccgtactcttgcccacattaggatttccggccagcgcaatgaccttatcctcttccttccgctttttgatttccagaccgcagtccacagattttattcccattgagtccctgcttaatcccatacctgctcctccaaggaaaccgcagcagccaccatctctccgccgcagtgatgttttgctttttcctctgcctttgactgaaccagaacacggcctgagtcctcgctcctaagggcgatcaccgcaccgcgtattaaaaatgccgtaggatctcctaaagggctttttccaaggcattccacaatggtgccctcaataagtccgatatcctgcaagcgccttctcatatcatcataagcggccagctttgcgatgaccgctttctggcctctttttaaatctgttaaataaatattttctgacattctttctgcctccacgtatctttcaaatgtttccatatcctaacatatgcaggaaataaaaatccggttcctttttattttcaatgcttttatccttcacaaaacaccagtctgaccctgaccggccggctgaaagacggtacaagcttttttcatccagattaaagatttatgcctttttgaaagatgaaagtaatgcttcatttttattcattatctgatataattttattaataccttatgtttaaaaggagggattcccatgcctgataccatgttcttcagtcttctgttaaatatcggtctgctggtgctcatcgccacattgctgacaaaaatacccatcgtgcgcggcatgcttttatacgataataattctccagggtgcatggcggctctttcggtcatattcggtctggtcagcatcatttccacctatacgggtgtacgtgagcagggcgccatcgtcaacacccgtgtgatcggtgtgctggccgcaggccttttaggcggtccctgggtcggtatgggtgctgccctgatcggaggacttcaccgttatctctttgatatcggcggctttactgccctttcctgtgcattgtccacccttatggaaggctttgtaggatccgtattttcccgccgttttaagatgggaaagataagcagcaccggcatctttctgatcaccgcacttgtggaaaccggacaaatgggaatcattcttttaatttccaggccgtttttagccgccctgcagctggtggaggtgatcgcatttcccatgatcatcatgaatgctctgggcatgatcatctttttaggaacctttaacatggtattcatggaagaagacagccaatttgccgaaaaaatgcgtctagcccttgggatcgtggagcagagcctgccccatctgcgtaaaggcttatacagtgccgcagatatggatgctgctgcggaaatcatttatcgttccacttcctgtgccgccgtactgatcacagatacccggaagattctggccatgaaatctgatgcaggtctgtgcgccttaaaaggggattccatccttgcccctattctggcatctcttcacgatcagaaacctaccatttttgattatgcaaaaaaggatgatcctttttatcctattttaaaaaaccacatgatcgtagctgcccctatgattgagatggaccaacccatcggcagcctgaccatggtgataaaaaaacactggcacaattcccaatcaaacctaaattttacttccgagctggcccggcttttctctacccagctggagctttcttatctggaataccagaaaaaactgcggcgcaaagcagagtttaaagccctgcaatctcaggtgaaccctcactttctatataatgccctcaataccatctcctacgtcagcagagagaatccggacagggccagagaacttttactctccctttcttcctactacaggcagactctggaaaatgaccagtacatgctgaaccttcatacagagctttaccacatctccagttacctggatcttgaaaaagcgagatttgaagaaaagcttcaagtagaaatccacgtagaagaagacttaaactgcatggtccctgccttcattctccagcctctggtggaaaatgccgtgcggtacggcgctgaccagacaggaaaccgcctggtttccattcatgcccataccacagaagataagatcgaaatagctgtttctgataatggaactgggtttccccaggaagtccttgaccggctgtatgcgggagaaagctatggcggtgtgggtctggagaacgtacacaaacggttaaagagcatatacgggccggatcacggactttatattcaaagctctgccaatggttccaaagtttttttcctgatcccatcggctgataccgaattcagatttggagaagaacttgccgcaactgctcacttaaaaaataattttacggagagattattatgaaaattgcagtgattgatgacgaacgccccgcccgaaatgaactgattcaccagattttatctgtttttccggaaagccagattcaagaagccgacagcggcgctgccgccttagagcttcttgaagatcattcttttgatgttttgttcctggacatcaatttaaacgatatggaaggaactaccctggcctcggctgtaaagcgaatgctgccggaagcccagatcatttttgcaaccgcttattcccaatatgcggtaaaggcatttgaactgggtgtggataactatatcttaaagccttttgaccctgaaagagtgcgccgggtccttgaaaaatgcagcagggatttaaacaggctgcaggcagaatgcacccaggcagacaatgcgcttttgcccttttcctctaataagatgcccatctgtgtgaaccggaccatcatcctgctggacatcagccagatcgtatatatagaaacctgcttaagaagctgcatcatacataccgtctcaaaggattatacggaaaaccagcttctgggggaatacgaaaagcgtctggctccttatggcttctgccgcatccataaaagctttttggtgaatttgaactacatcgcagaaatgtttccctgggccagcaacagcatggccgtcaagatgcaggggtttgaacaaaacatccttcctgttgggagggaaaaagtcaaacatctaaggcagctcatcggaatttaagccaattcatcctgtttatgattatcattctgctgtttgtgcatttagcacttacgttcatgcaaatatcatttatttttgtgcatattatagtacaattttaaatatgaatggttttcataatattttacaggaggtatgaatatgataagtttctttctatgtctggcactgctgatcatcggtttcttaacctacagcaaggttgccgaaaaggtatttggaccagatgacagaaaaactcccgctctgaccatgacagacgggagtgactatgtacccatgggaacgccaaggatttttctgatccagcttttaaacattgcaggtctggggccaattttcggggctctggccggggcctgctggggacccagcgtgttcctctggatcaccttaggtactcttttaggcggaggcgtccacgattatatggtcggcatgatgtccatgcgccataaaggcgccagtgtttccgagcttacaggcacctatttaggcaataccatgaagcaggtcatgcgtgtattttccgtgatcctgctggtgctggtgggggtcagcttctctaccggccctgcaaatcttcttgcaatgctgactccggaagtgcttgatgcccgtttctggcttgcagtcgtattgatatattatttcatagcaacttttgtccccattgacaaggtcattggtaagatttacccgtttttcggggtctgtctgattgttatggcccttggggtaggaggagctatactcttaaaaggctaccatattcctgagatcaccttatcaaaccttcatccgtcaaatactcctatatggcctaccatgttcatatccgtcgcatgcggcgccatatccggcttccacgcaacccagtctccgcttatggcccgctgtcttaccaatgaacaggacggccgtaaggtgttttacggggcaatggtggctgaaggcgtaattgccctgatctgggctgctgcaggtgttgctttctacgacggcaccggcggtcttttgaccgctcttggcaatggacaatccagcgtggtttatgaaatctgctttaaacttttaggacctgtgggtgctgtcatcgctatgatcggtgtaattgcctgtcccatatcgtctgcagataccgcttacagaagcgccagactcacactggccgactggttccaaatggaccagaagccggtgaaaaaccggctgctcctcacggtaccccttctggcaatcggctccgtactgactcagtttgacgtacagatcgtatggaggtatttctcctggagcaaccagacccttgccatgatcgcactgtggtctgcaagcgtgtacttataccgcaggaaacgtttttactggatcacagcgcttccggcaacctttatgtcagctgtttcctgcacttacatcctgattgcaaaagaagggttccagctttccaccggcattgcttatccggtcggaattctgtttgcagcagcctgcttcggagctttcgtctatacctgtgttcttggcaaaggcaaaaatgccaacgccgctgcagaagaagagcagtcggccgcttagtcctaaaaagggctgtcctgtcaaatgacaggcagcccttttcctatgttttacattttatggcaccggctccacttgcttccgtctctttctccttccaccacaatggtcatgggatccccatctggagcaaatgtcacattcctgaccggacaaggcccattgctgctggtgatcacatgagcaaatacaacctcagggccataggcacgttcgatctggtagttgatatcagatacagaaggattatccggacccattccggcatacagttccttcccctgcccccaggaaaatacccgggtatggatgccctcatcgtcgtactcgtggacaacgctgagttgttcttctgccggaacagtctttttcatgtgatggaagtaactgtatggcttcctgtctgaaaaggtttctatccggactccttcaggctgtttgatccgtgttcctgaaaaatgcatgacccagtccaccgggagatttctatctgctccctcaacccggaatacttccccgaaataattctccgcccatacaatctttcttaccatttttacagggcggtaatgttcttccttccactgcacaatggtaaagctgtcaggcatttcatacggaacggtccagtccgcttccgcctccacatatacgatcccatccgtttcttcataacgggtaagccttgcattcacaggagcctgattctcttcaccgatgtttaccgtattatgggaacctgtatttttataataatcataatgcatgaccgcaccgtatccggtggttccaagatcaggggaaattctttttccacaggctaagtagctgatatccagccggtcgtagtggtcgtgctccccgccgtagcggtcatgcttaaacagcagatatctgccgtcctccccccttaaaaccgtgctccctgaccggccttcttccacatgataattccctggctcaacagtgcacccgggcagctcgcgggccccatagataaatgcttccagactatctctcttttcttcttcataaagccggttcaatacaaaaagaagcttctctcctcccagctcccggtaggcaaattcatataaatacagacttgaggacgtatgtccgtaattggtatcattgagcataggaatacggaatcccggttccacataggacaccagaagctccatcattgccttgtaattgggatgactgatgtgactgtgaggcgtatgaagggcaaatttttcataggcaaaaaagctggtaagggcgtaaaaatgatatccgaacgctccttcaaaccacatgtgatcggcaagcattcccttttccagctgatacaggatcccataaggttcatagaccgcaaaccggacataccggtcaattccaaagatcaggccaatgaccgcaatggcggaattgatgatcacctcatgattgtgcagctggttatgccggtgttccatgagaaattccgccccagggatgagcatttcctttccaataaacgctttctcctcttttgtcatgaaatcagacagcagatcatagctcatggcaaagcttctgaggaaattggcttcatcaagggtctgggcgccggactttccaggcccgttgtaaggaatatttccgtgtacctggtaatccttataataaccggaatattccatcatgatatccacggcctttcttgcataagcagtttcctctgtgatcagatggatcagccccatctgaaatgccgccgtataattcctgctgttaatgatcccccaccaggtactgtcatatggttcaccggaatacacccgcccgcaggagggacagccatgatgatgcggatcgttccggtcaaaggtcagcctcacagaacaatccgggcagtaataataaagggaccagttggcaatccctgttttgggaaccagaaccggctccgccattatttctttcacatcttccttgatacgattaacagctgaccgctgcttttggaatttatcccttaaatgccggatctcctgttccgtaaattgaatcatctttcttagccctcctaatataaatgctcttcttccaccgcttttttaaattccgttggagtgcagccgtaaaatttcttaaagctgctggcaaaatacctctggttttcatacccgcactggtctgccacctcctggattttcatgcttgttttctgcagcagccggccggcccgttccatgcgctttcggatcaaatattctccaaagcactcccccgtgtactgcttgaaaatctgcctgacatagctggggctgaagtgcacctttgcagccactgcctccaagtccagctctgttttgtgcagatcattatcaatgatctgcttcatttgcttcaccactgcatccgccttggtttcctcagaattctcctgtaccacccggcagcactgttcaatataggaagccagcatatggttcatatccatcagacttccgtaagtgatccggtcctgcataaaggacaggggctccgtatccgcccggtcatatccatcctgctccatatcattttgaatggcgtaaaccagttcccccacagatacgcccacatagtcgttcttcctgttggacagggaggcataacacttcatcagaccggaaagccctgtaagtgcctcagcctcctgtccggcacgcacggaaagccggatctggtttttccactcccggatctggctgctgctggtttcctccttcctgctggtttcctctccataaaacaggaatttcttttctgtgtctaagttcccacgccacacggccatggcctcccggtaagaatccaccagctctgcctgactccggtaagcgcggccaagagcgccgttcatctggatatggtaatacttctccaggcttgcgctgattttatctaagcttgccctgatctttttaaggaaatgttcctcatgttccccgtcaccgcaccagatggctgccagctggatcccgtcaaagctgactgcatacaggcttattccggcagaaagataaccattccgtatgagcatgagaaactcctccacatgctcctgcttgccgaaatcccatgctccgccttccatgcggatcactcctgccgcataaaaccttccttccagtataaggtccggctcttccccccactcctttcccttaaggagtgccttcagcgccttttccctggcaaggccggcccggctcattgcctgttcctttaacaggctcatattttgctgcagcaccttctggctgtccagttcctgtattacctttgttaatacttcaatcatttccctgggtagaaaaggttttaacagataatccttgaccccaagtgaaatagcctgttttgcatagtcaaattcatcgtagccgcttatgaccacatttttactgtaaagcccggcttcctgaatcctgcggatcaattccagtccattcataaagggcatggcaatgtccgtaatgacaatatccggcttctttaacagagcttctctcagcccttcctctccgtcgcctgccgccgctaccacatccacttccaaagcggaattctggatgtttctcaccagtaaatctcttacatagtcttcatcatctacgatcaatatgcgatacatcactccacctcccctggcattgccggaatcctaagtaccgcttttgtccaatggccgaagctgctttcataatgcagtccatattcttttccataaaacagccggattctttcattgacattatagatgccatagcctgcttcacagtccgttccgcccttttttaaggtttcattgatgaaagcaagcgtttcttccggaattcctgccccattgtcccaaacttcaagctctgtgatcgtttcctcgccggtcccctcttcgctgacagagatttttatgataccggctccctgtttctccttgattccgtgataaatggagttttcagccagaggctgcagaagcagcttgatcatccggaagtccagacatttgtcatccacatggatctcatagcttaaacgggaatgataccggatgctctggatttctaaatagcttgtcacatgttccagctcttcccgaagggatatcacctctgcccccttgctcaatccgatcctgaaaaacttccccagagaattggaaaggatgctgatttcttccgccccctggtcagcggcctgccaggtgatggcatttaaggtattgtagagaaaatgaggattgatctgagcctgcagagcctttaattcagctttccgcttctgcttctgaacttcagccacataatcccgttcccgtttcagttcctcaatggtctcctcctgtttccggaccaggctctggatctctccgatcatgtagttaaaggactttgccaggctgcccacctcatccttgtagggatagaaaaagcggactcctaagtctcctttttccacacagctcatgcgcttttccaaccgtcttaaagaatccgtcatctggtgggacaacagcaggatgaccactacacctattaagaatacgacccccatgatctcaaaaatcatgtttcttaaaatgtttaagcttcccaataagctctgccttgatttcagaccatagatctgccagccgttttcctttaagcgttcataggtgaccagataggaatctccctcgtactgatagtcgctggtaatgacattgctcccctctttcctggcctctgacagcttcatcagttccccagggtccatgtcagaagaacctgtcattacgtttcctgccccatccaggatgagtatcttatcgaaaaattcgtattttccttccaaaaggcgttccagctctgttttctttatctggatcaccagatattccattcccacatagccctgaacgctgaactgccatacacagggatgaccaggtcattatcctggaaaatctcatccttccataccgggaaccagcggattgccccgcctccgctttctttatagcttttgtaaaaaatggactccttaaaatcaaacccccagtttctcatgcggacaaaattatcaaagctccctttatccgtgtaaatataggtggagtggatcagcccctctcctgtctcaaagtctctcataaaatccggaatggttccaagagcttttaccaggttgatgtcattgggattattgagataatcggaaagagtcaccataaaggtataattggccagcatccccttggccctttggttgataacccccagccgcatgcctaaagtgtccacgatctgggccagaacatcttctgctcccactttaaaattctcttcaatatcattggaagcgtacctgtaataggataatccgctgatggcggtagtaaagaaaaacatgattccaaacagccagatgattttgctgcggaaccttaaattatttataaatttcttcatgctttcctcccgttttcctgctcgtctgctttttaccagtatatcacaggatccgccctttttcccagggcgtgtttgaaaaatgcttgttccaagctgtgggttcctctttgtgggagatttgttccagatgaaggcggcgtagtgggctacgccaactgaatctggggcaaatataccgcaaagtggggcgtgcagattgggccaatgatttttcaaacacgcctacccttttaccgcacctgccgtaaggcctgcaataaactgccggttggcaaataaatagacgatcagaatggggatgatggcaatggaagctcccgccagcatgatgtgccactcagctgctgcattgacagaatatttcagctggacaaccgccacggtaagagtctggagccttggcatggaaatcgtcatgatcaggctggtgatataatcattccaggcattccggaaggaaaacagggcgactaccgccaggataggcttgcttaaaggcagaatgacccgggaataaaccccgtataagctgcagccgtcaataatggccgcttcatccagctctcttgggattcccttggtaaagcccatgaccagaaaaacattggtagcctgccctcccgtaagagccactatcagggcaaagatggacttatttaactttaatgccctcagtaattcatagatcggatataaggtaacagaccctaaggatacgaacatcatggataagtaaagggccataagcaccttttttcctgcaaactctcttctggccagaataaaaccggccaaagaacaggtaaccacagccagaagggtaacagaaacgctgaccaggatgctgttaaatgtatattttgtaaagtctgcctgaacaaaggcctggtagtaattctcaaaatgccattcctgggggaaaaaaccgcctccctgagtcagctctgcattggttttcaaagaccccagcaccgtataaatgaccggataaagggtgaacagaatcataattcctaaaaatacccatttaccgatcataggaagccaggctgcttttgatatgtgtttctcattccggtttttcatgctgccgcctccttaataaatgtcatccagttttttagatattttcagataaccaaccgttacgatacctgcgatcactgcggatatgacgctgactgcggcaccgtagccgtattggggcaccgtggcctctgccgcagatattgggaagaaataacggtacccgtataaggacattaccatggtggcattgttaggccctccctcggtcaataccatcacattggtgatgtcgtgaaaagctgaggtgatggcaagcataagtataatctttaatatgggcccaagcatgggtatgatgatgtaccagatggtctggagctttccggctccgtcgatcctggcgctctctatggcctccccggatacctgctggattcctgctataaaatacaccatgtaattgcccacgccgccccagaccgccgtcatgatcagggttttcatggcatggtcttttcccagccagtttatgggcctttgtatgagaccggccgccatcagatactggttgacctccccattgtaggcattgaataacagataaaacaccagacccatgaccgcagagctcataatggtaggtaaaaatataatgctctgggcggccccattcccccgcttttgctgatttaaaagaaacgccaggaaaaaggcaagaggtatgataaaaatcaccttcccaaaaccataggtaaaggtatggaccacactttcccaataaaccttatcccggaatacccgggccagattcccaaggccgacgaatctcggtactcctgttccatatcccccatactggtaaaacacatatttcaaggtccacaccaccgggtagagggaacagacgctgaacaaaatcaggttgggcagcataaacgaataggcctgcaggttttttttcacagttttgctgcttggcaggacacttctgctattccagtctttcatctgcatactcctttcttttcaaagaaagaggggcctcgctgattttgcgcccctctttcagatgttactgtaaggttggattcattggatcatagttgtcaatctttacttcatgaccgcttccgtttttcactgcttcctgatacgctttattgtaacggtccgttaaatcctttaaggtggattcaatatccgcatctccgtaataaatggattcgcaggttttatacatatcctcaccttccactaccatacccgatgcaaaagcactgtgaggaggctttggaaggagtgcatcaatgtcactgatgagcagccactttttattctggaaatcctcgcttggctttgcctttccgataacgcttggaaggatgctcacgccaaatccgccttcgtaatatccgattaaatattcctcattagcaaaaatatccttataaaccttaaatgccttttccacgttagggctcttggcatttaaaacatagcttccggtaccggtaaaatactgctttccttcggtctttccccccacggtaggaatgggaacacagtcccatttggaggaatccatggggaactgattctggtatactcccggctctgcatggctgtaggacatatacatgccgatctttccggcggcaaactgggttcttaatgggtcaatatccagagattcgcagccagggaaggcacattcgtcagaaagcagttctttccaaagctttaaagtatccgcccactgggtaaaatcatattctccctttgcaaaatcatatccccgaaccagtccggtctctctctccaggccgatgcacatagaacgctgcaggccggagctggcgcttttcatgttttccgcaaatccataaattccttctttggacaattgggaattgattgttttagcgtactccaccacctcttccagagtctttggcggttccgtaattcctacacgttcaaagatctctttgttatagaaaagacggcaggtggttccgctggttggaatgaaatacagcttcccatccatttcattgtaaccgggataaaccacggacttaaaatattctttcatatcagagtccatgaaatcatatagatttgcccactgcccttcgttcacatatttatcaaacatctgctcctgctgtaccaaaatgtcaggaagttccccgctctgcaccgccatatcaatagcctgcacgtaattatccgtataaagctggtaatccacctgaatgttatccgtgttgttggcattataatcatcaacctttttctgaacataagtggcgtcatgccggtctttggaccaaaccttaataacggtcttctccccgcttgctgcctgggtttgctccgttcctgcctgggcagtggtctgtccccctgctgccgctgttgtggcatctgtcttgccccctgagcatccggccagtgttcctgccgtcataagccctgccatcagaatgccgcttaatctctttaatctcatccctttaacctcccgtgtttgtttataaattcattttacggaaaaacagatgttatgtaaatgcaatatctgacggttgcatgtttaaaatcagtttatattctccttcctcccattgacataccgtctccctgctcttataatgtttatattacatttgtaagaacaggagaccgcatatgaaccatctgccgcaaatatccgaagcagaatatgaggtaatgaaggtgttatggaatgatgcccccatcagtaccaacgacgtgacggaaaaactgacgaaaaccaccagctggaacccaaagaccatccacacccttttaaaaaggctggtccaaaagggtgccgttacctaccggaaggaaggccgcgttttcgtctataccccgcttgtagagaaaaaagaatatttaaagaaagaaaatgatcattttttaaaccgcttttacaacgggaagatctccggcatggtgacaaattatataaacagtgaccatgtatcaagggaagacttggcagagttgagaaagcttcttctcaatggccaagaggaggaaaactgatcatgcccggttcatttttgatacgcctctgtcttaacagcatcgtcctggccgttcttctgacagctatcctgctggccaggaaagcattcaaacatcaattgactcctagaatccggtaccatctgtggtttttgtttctgtttgtgctggccgtcccgtttctgccctgttctgttctgtttcccggatgtgcggttaagctgctgcagtttttaggcagctctttttcccccgggaatgccggaaccatgggagctgcctatcaaaccgcagcagccaccgaatatttccttcaggacttttctgtttccgtaagccgtgctgcgcctccggcccttccctctaccttaaccggaatctggatagccggcatggtattcatggccggctttaacatttactcttgtcagaaaatcaggcagctgaaaaagtcctctcttcctcttcagaacaaagaggtacgggacctgtttgcagcatgcagggaagaatcgggtataaaaaaagaaattccggtctacagcagcgcttatatatcctcccctattgcggccggattatggaaaccctgcatcattgttcccatccatatgctttccgggctttctaaaaaagagatccgttatatccttctccatgagcttttacactgcaagcacaaggatcttctggtaaacaggcttatggccctggcacagatcatttactggttccatccccttgtctggtttgcctttagcgaaatgcgaagcgaccgggagatcgcctgcgattcatcggtcttatccctgctggatccggacagctacttagattatggaagcacgctgataaattttgcagaaaagatatctctcttttcctattccgctgccagaatcggcggttcaaaaaaggaaattaaaaagcgcatcttaaacattgcctgttaccgcagagaatccagatggcatcaggtgaaaagcaggattcttttcaccataatcacagtcgtggtgctgggctgtactccggtgctgtctgcagatgcctacaccggttcccaatatgtttttgctgcggaaaatgtaacagagctggatttaacctcttatttctgcggatacaaaggcagctttgttctgtatgagctgaattcaggtcaatactgcatctataaccgggaaggtggaacaagaaaggtatctccaaattctacttataagatctacagtgctttagctgccctggaacatggatccataacaccggaagcctcactgcgttcctgggatgggaccagctatccttttaaagcctggaatcacgaccagactcttgactctgccatggagcattcggtcaactggtattttactgccctggacgaaaagaccgggctttccagattaaaacaatgcctggatgacataggctatggcaacagggacttatccggtggcctggggcgttactggctggaatcttctttaaaaatttcaccggtggaacaggtaaagctattggcccgtttctgccaggataagcttcctttccgtcaggaaaatataaaagcagttaaagaatccatattcctttcatccttcaagggtgcttccctgtacggaaagacagggaccgggactgttgatggagaaaatgtgaacggctggttcatcgggtttgtggagaccggaggggaaacctatgtgtttgcaactaatattcaggggaaacacaggctaatggtaccatggcgggaaagattacattggatattttaaatgatagagaaatttatacgcaattaccataaaaatgctgctgtaccggtgaaatttgaccggggcagcggcattttgttttcgagaaaagtgttattttcctcgctttcgtagcgggaatcagcattgtcctttgttaccatttctttaactccgataggtattatggatagatttgcgacattattctggcatgattattgtatatgcaaacagcctctttcttcctttttagagcgttataaaacctagtgtaaaaagaaaaaataactttcaatctgaaaaatcagttataatatacttatctcaatgctacccaaggacaacgtagcaaagcttttaattcaacagacggttgatcaacttaatatcgcctcaaaaaacatagaaacacttcgcctccttatgaaccaaacagccacaaaacttcccaaataccttgtggtaatgaacatgactggagtagaaataactctttatccacaacggtgctttgacagcctataccggtgttgatcaaggtgctaatcaatcagagactatgagtagcaaaacgttagtaccttcaaacgaggaacaccacagcttagaaaaattttgtttcttatcatggattcgcttaagaaattagctccattatacgatctagtttataagttcatgatgaaaaaacgtgcccaaggtaaaggctattatgtctatatgacagcttgttccaacaaattcctccgcacttattacggacatgttaatgaaatatctttcatcattgaatgtccaatgctgatttcgacatacctaattttaagccggcaatattgggcggccttattgtgcttccattttttaatataatttttcttaaaataatacctgattttttctttgctggctaccgtgcggattcgggattttcactcgttgaaacgtgcgcccgccaggcacaccataataatgacgagtacaaaacccgaaacaatcaggctttgtactcgtctcttttaaaactttaaattgccttttctccattcacgcaaagtcatctcagaattaaatgccacaggccttcctttaatatttgaaagttcttctaaagttttctcagcgttcactggggatatttgtaatgtataaccagccgcccacgatctaacataaggatcatcgtggttaagtaactccaatagttcatttaggcgtttttctttttttagtagcaaataaattgaatttattactttatattgtttattaccatttttactatcaccaatttcttcatacttgcccttaataacacaggcatctgcaaatttttgaatatcagagttcatattcattctccttacttaaatggtgtaaatatccaacctatatctatcgatatcatagttccatatttgtctaattgtcgcaaaccgtactcaaattgctgttgatagctttgccctgaaagccattgtctaacggtttgtccatttgtatattgttgaattgatgagtaatgtccacttatttgactatgaatacttccagaaaatccagattcaattgatactaaattcttggtgttatgaatatcggttgcattaaacccagatttaattatttggttttgttccacaatatgatgccatgctttgccatcccctgcggagcctaaggctttttttgcatcactaaaggtattaaaccctttacccacgccatttacagtcttttctactacctgttgacctcccgcagctactgtagaaatgccagaacttgtaactgatataccgcctactcctgtggcagatgctactgccggtcctgctaaatatcctactgtagcgccaaccgccgctccgacaactactccgccagcaatatatttccaccggtcttggcttgctgcgttaactttattagcaatgtagtttccaacgaaaccaccaactactgcacccactgctgccaatccaatagccacaagaacagtagtacttattacaaagtgtccacccggatcctgataataaagaggattattatgggtatatgtgtaaaggtttaaactcaatgggtccggaactttcatgtagttaggaagttttctcatgattccgcgcacactatcttccgtcgaaaaacgtcctgtttctggcctataacttcttgctcgtaagtaataagtattcgactctaaatccagatactccccacaatacctgaacggattctcgtcctccttatctgggcttctctcaattccaaaagcatcatactcatacgaggctttacacactccgctttggctccacagttgggttacatccccatgttcattaaatatatagtagtatatcacacggtctatttctctggcaatcaaattgattcctcttaaataggttttaatcttttcgccgtcagtctgttccgctacgatatcgcttccatcccagcaatacaaattcgttttgccctggctttcggtcagtttccgcacctcagcactatggcgcaggccatctcctcggtactgatatgtgatctctttgtcatcctgattgatccggtacagttggttgaatccatcatattgtctccactcataaacggtcgcagcccccttctgatagttccccgacaacttaacatttcccggatagtccggcgttggcgctgttttctcccaaatccggaaagtttcattcccattatcatcataacggtaccgatacgtttcggttattttcccctgcttttttgtctccttttccaatcggttgttcaaaccatattcatagctggtaacactgaccaactcatcctttgttcttccttccaccatcattttcatacggttggaataggcgtcataggtataaagcgtccgcttccagccggaataatcttcttctgtcagacggcccagccgatcatagcaataggaaatcgtaactggggcagaaccggctttgttaatcttgcttagaatgttcccatccacatcatagccgtattcccatgcagaaattatggttccctgccgtttattctccagtgttattaccctgttgccatcattatatttatagatggtttccataccggactgcggatagcggagggttttacggtcgcctttttcatcatattcgtactctgccagtatcaccccggcagcactgttttttcttacctgctttaaacggtataaatcatcatacgtataatacagactgacatccgggcttgcatttccttggcgggtcagttgaaaggactggcggtttccatatatatcataagtataatccttccctgtatttcccggatcctcctggcggcacagctggcctttattattataacggtacttcgtctccaggaagacggtttgttttcctcccacggattcccggctgacttctttaatccgcttaccgttcttaccatagaaatactcccgctcgctcattaccagtccatcaggagttctcttttgcacggtttcttttgtcaggcgttccagggcatcatgctgataaatggtctggtccttgttcctgtccgtttttttctgcagtcttccggctttgtcatactcgaagtattccgtgcagccacgtgaatctgtcattgccatgacatttccaaagcggtcataggcatattttgttacctcccgcccttcgccggctggggtatccccggttctccttagaatgacctgattcatcgcatcataccggcaagtggtcctgatccagctgcccggacttaggtactggtaggtatcagtcagccggttcctggcatcataaacatactgagtctcctgccacccatctttttgtgccttcttttcccctattacatttccagctccatcatagttatatttcacaatctggctgcggtggtcaaacggtgcagtgatttgaatcaggcgtccggccttatcgtattggtattcagttttctttccggcttcatcccaatgaaaccgtttattgcctaacgcatcatattgaatgctggtaattctctcctggccggagtccatccatatggattttactgcccggcctgcataatcgtattcccagcgttccacattgttcctgacatcaattttccgaatattgtttcctgcattgtcatattcgtaggtaaacagcttctccccggctaaaatttccttccgaacctggcctttctggtccttataacattctgtcacgatatctggagcggaagcatcccctatgacttttttcagttcgcgatagtacttcctgccatcagccggatcggtaaatacctcattgtattcatacttctcctcatggcctacttgcggaatcgtatgggataacacccggccaaatgaatcgtaggtatagcgctcagtctttcttacatgattcgctgctgtgccgttcccatcatatgtgactgtttctgtcagctctccccatgagttataccgaaaatcctgcagtactacatcaccggaagttggttcattggatacggccaggcagacctgtttaatctgtccaaacggtgtgtattgaattcgtctcttttggtggttcgcatctgtttccgtgataaagtttaaacggtcattataataggtttcatttactgcctgctggccgtctgccggaggcaacgtctctgcttcaactcgccccataccgtcatagcggatggtactgacctgattcctggaatcctttttggagatgagccgcccccaattgtcatattgaaattcttccttgattagatcgcagggccttccgtccgcatctatgataccggtttgttcttttgatataaagttatgtgtgtatctgctggcagtactggaaggagaactgtatttataaattatttcagcataatcacctgattgctccagattcccgctgcctgccaggaaataccttctttcgctggtcacacagtagggatttttcgaatctttataatcatatcctgttttttcttttaagactccattttcatagatccgatgatattttattaccctatttcccaattccgtatgaagctcatttgtttctctgatctggtcagagcctttttttctcgctgtttcaataatgatgctgtagtctccatagcttgtattaatttcctggctgcaggaagggtcatccggatattcttcaatgagctggatgatatttgctttttgatctgcggaatatttccaggaggttttcttttccagaaatattgattcattattcctgtcaaatacctggtcaacggctgatacgattagtttattgctatatttataaatgcttttagaaataagggtctcctgatgccggacctccttttttattagctgcccttcccgatcaaactgatgggtttccaaaatgtcctgatgatgttttacttctgcatattcgatatacttaccattgccatattcataggaagctccggattcaagcctgtatctgtattctgcccggttgtattcgattccgtcagcaatatcctttttcatcgtcaatgcaaaatgggtaagctttccaccggcatcatttacaatgctgatttctctgccatatgtaaactgtgtggatgcatgatttggatatgtgacactttttaacagcagataattgcgttccttatttccggtagtatttcctacagctttcttggaggcataactcataatgcccttgtaatctcccggattatagtagttatattcagtcctacagcctgcggggtctgttactgcggtgagcttaagcggctgcgcctgatcgatatggtaggaaagttcacatgcctttcctgctgtactttccggcaatctccagataaatccataatcggtcttctccaggctgattttacgaccccaggtgtccacaatcaccataccgccgtaatcctttaaatcgtaacaaatcacatttccaaacttgtcctgccgggcaaccagtgtaaacttctggggcgtcagtttatcccggtctccatcatttccaaataaatttttgaaataatctttattaccatttttgtattcaataatgatatcataagcttttgtaatatcggctgcataagggtggtgaatcatgcctgatctggtaaaaatcctgacatcttttaggctatgatctacaattccatctgaagaccgacttatttttaaacttctgccgtcttccagatgcagaatataatcaaaagcggggaatcccattaaaaatgattccggaggatcataagataggatcaggtaagaacatttaagatacggtaccgtctcaatggaaggcaggacaaaggaccagccatatccaagtccataagtcttggtataaaaactgttatccctggaacctgtatatatcttttcttttttgacatatggatccatatccactaaattggcacagccggaatcatagcgtctggcaatggatacgtcgaagccatccctgcccggcagtacaaagtctgttgtctcatattgaacattgccagtgttcaactgaacatttacctgatttgtttcgaagtaggtaaatggggattccggatactcttttatatcggaaaattcttcctcctccgtaggcagcgctgcccggctaagcagtgtttcccggatttttgcttcattctgttctccgcctgatacatcctccgcagcctttgtatcaggctcttcccattcatttttaacaatgtgattttctattatctctttctctttctctttcatctattcccttcttatcttaaaataatgatactgctgcgcttccggttccccttgcgataaattctaccaatgcaatggaaccgctaaagcattcgttttgacttagctgtctggttgactgaaaccacagctttcccggaatattggaatatattcttaaattttcttccggataatttcctggttctattatgcttcttagattgccggctgcgaggctggttaattccagtaagtatggatcataccggaggttcatgcggatcttgtccagaccgctgacctcctgggctttcagcagaactgcgtaacgtttaccggtctttaccgggtattccatggtgctgctacggtaaaatacaggaataaccggcatttgttctgttgttaaataatcagattcatcaccttgtgaatcatatgctttaatccggtacattgcgttagatgccccaattggaatgaaatctgtcattccccggtgctcttctatctgtttctgtgtatccaattcatggaaggtcaagccttttccttcccattcgtcaaatgtcagccatctggattcaaaactctcccatgagataccaggcagcgtcaccttctccccctcaccccatgaatgtccggattcttccaagcggctccatgttttattaagctcgtccagttccagccatgtacgtccctgctcaatgccggggtgttcatcgcctaaacctttaaatatttcaaaactgatttcccggttttctaactgttgccaggtatacgaatgattctcaaactgtgaccagcttaactgctgataatccaggcgttcccaatgctgacctttgcctgttctggtttcgatttgatgccaagtgagggcatcctgatcatacctgctccatgggtcattggtactgtcaaaattgtcccaggtgtatccagacaggccctgtaaaaatgattcattaaatacccgttctaaaatataatttttatctgcttccacagctccccaactgatttgtgcctgttctccctcgtggagggtggggatatgtaaacattccggtcggttcataaataataggtttctcctttcgttttctattggtaatcttagtttttatttcatagttgattgtatttggagtatttcgtctggtactccgcacttgtatctcgggtggttatgatattttccattttagtatcatgcgggtttttgtcgtttttattttttggcagtagggattacctaatataaaaaatcatttattatgctgatactcatccaattaagaggaagaagaagtattagcagttccgtttgacttaactaaatagtgatttagataacaatacaattgtttcatctggtttatacctatcatggggaacgatagctgatggaggatatacgcagattggaaaaatggtttttgttaatattagaatagtcaccaattttgcccttactgccggcaccagttatactataagcggcttccctcgatgccgtaataccaacgcacttaatacggttccagtgcaaatcagcagtccaacagggatgtctaatggatacttgacaattggtggtatttttacatttacaccaagtacaggcgctggtattggcagcggtgccgcactgatatttggaacgtcatatgttacggtataatgatcatttatacaatatgtacatgttatacataaccgtgccggtataatcggagcatatctgcaccctaaaccctacagactctgaatacatgcttgacacactaatttgatggtaagtatttccggggaaatagcgcagtgttgttataacacctataatagtttttcctgttaagccaaactcagaaactgtgtaatccttttgaaatagtgtgttcgctgttatcgctgccccggatgatgcataatgcaggatctttgtcaaattgctatttgttgtagcaatctgattctgtaaatcactatttaacttagtaatcttctcattaataataacattatcattaacgaaatcctgtcttaccggcttatccgatgcttcccacatatttaatcctaatgatgttttatttgtacttgacatattatttttcctcttctaatttgaattttttttctttgatttctttagctgtaaaactattttactcattttctttcaacaactctggcataaatcttattttaaacatttgtaaaataaaagaaggaattcagcaatatctattaatggccaatcttttagtcaagtggatattcgcaatccacttcgctacttgttcacggcgtccccgatagtgcgggggaggccctgccctgctttatcgggcataaccgaatagcagctgacgcttgtgtcaggtgaagcttgtactccacctgacacaagcaagtccccacccaccactcaatgcttttcgcatttgaagtgggggacttacttgattcggttaaaatacaattagtaccacgttataggctcattaaggcataaaatgtttaccgcttatcacgtttattcagatcatttaactgttacatacattgctacaaacaatctctgatccaatgcgctatccttctcgcatactcgaacatatgttctgttttgtcgacatctgaattataatactcttgaatcatgttgtcaatactttttccgaacatatgttctatttttaataaatttaagattacaactaaaataaagaagtaacttctagtttcaagtattaacttctacaactatcgaagttaggtgttctactatcttacaatagtagaactgtctgttcagaaggcaggcatttattagtaagcacatacatggcggataacttctcgccctatctcaaagagttcaattgagaggggcctaactgatagaaaaccattttctgtagtaccacggataactggaacgtcaccgagtaccatttctaaagaggtgtcgagacatagggcactctgtaaaaaagtcgatcaggaaagcgctgtatgaattttatgttcagaatataaaccgaaagaatgtgagagaatgaagaagcctacatacgtctgcaaaggctgcaaaaaagcaataattgccttatgcaaaaagcccactacatcgcacagatactcaggaagaatactttgaagtattgatttcgtcaagagatgggattaatcagaatgtatcagatatagctcttctgggccagcgaatctctccccttctcaaaaagaggtaagcattgcacatatccatgcaaaccatggcggcgagattccatacagccgcatgacgctctgcaactatattgatatgggactgtttgaaacacgtaacattgacatgagaaagatggtttattataagcctcaaaaaacaccaacatgtgtcagttttgtggacaaagatttccgaatcggacatacctatgaagattttcaaaaatatatgaaagaacatccaaatgtttctgtagttgaactggatatagtgatagagaaacaatcaggcggcaaccagatattattaactgctttctttcacagctgctcattaatacctatcattcttctaaaggaaaaaacgtctgattgtgttataaagacattcgacaagcttacagcagccctggaaatacagcgttccaaaatcttttcccagcaatccgaacagataacggacagaatcttattatcttgtagacttgaatacaatccaaacggcaatatcccaactaaaatcttttttactgtaatccaaatgcagtccagcagaaaggcatgattaaaaagaaccatgaatacatcaaccttgtaatacctaaaggattcagcatagactataatacagaggaagatatcacaaggcgaatgaacaacatcaataacaaagcaagggacagtctgaatggctgtaatccatttaaactgtccctaatgatctttgattatatactgcatgatgtacttcaactaaaagaaatcgcaccaaataaggtgtcactatgtcctgaactaataaagaaataaaataattggcacaggcgattcactatatcgaattaagtcctatatttgagcgagtggaacttagtcctgtacactttttccaataccttaaataaggtaatataaaaaacataatgatgctttaattattattataaacctgcgatcgaatttgttaattaaaaagtggaaataagttctgtatattcaaccattacgctttttattaaagtcattcttttaaagtcactttttcatttaaccatttcagattacagttccttcccatccaattaaaaaacacataaccctatgcaaaatcaagaaaactaaaaaatccctaattttttctcttagggattttcagtatatgtttatgcatagtttcctgatatcatattaacaataaaaacaaattttacgaaaaaaagcaagaaacatcccaaattcaaaccagcacatcagcattctttaccgtccccccggaatataagaatccaatatagctttatcctttctcaccacatacccgcttcctccccggtcctttacatcctctgccatactgaccagaagaataggagtctctaactttggatctgtcgtaaaaacagcaaaccaaccaagctccgtaccgtttttatcctcttttgaagccttgatctcagccgttcccgtctttcctgcaagctctacatcattccggtatgccccatgtccggttccatgctgggaactgatgacttcaccaagagctgtcctgatcctgtcagcaatttccggagtacatgctcccggcagccagacttccggtgctggttccggcttgtactgcagatacggcttgatgacgtttccattattggcaaacatggtataaagggatgccaggtgtatgggattgaccagcatctgaccctgtccgtatccgctgtcagccagctgaacctctgtttcgatccgctctgtattggagtactgagactttgttacggatatatcaaaaggaagctcctgattaaatcccagtttatccaaacctgacataaaatcatcatagccgatttttaaggcagcctttgcaaaataaatgttatccgaataaataaatgcgttttccaggatgacagggctgtaatcatgaagggtggtaacatagtaatttccccagctttcatcctttctccagcttagccctacgtttccgtaatcctcattgggatcaatagccccggtggaaagtccgatggcaccggttatgggcttaaaagaagatcccggagcaaatctctgacggaaccggttgaacatgggttttctctcgtcatcatttaaagaagcccatgtttcctcggacattcccaggataaaatcattgtcatcgtaggacggcgtgctgacaagggccagtacttcgccggtataaggattcatggcgaccgtacagctcttatcatctttaaatgcctcataaatttcagactgaaggttgctgtcaatggtcagggtaatatcctttccttctgtccgcggctttgcagccagggttttcttaagtgttccgccagaatcagtaatggaaaccgtccgtccattggtccctttcagctctttctcaaacaatgcctccattccgctccttccgataacactgtcagaaagataatcctctcccggatgcttttcaagatcctctgccgtcacattctggacatatcccaccagatgggcaccgctctttcccaaggggtaatagcggacttgcgtatctgtgatcaggactcccggaacagtcagaagctcatcctggaattccttatttttaacattgtcctccctgggctccatggaatttaaattcagttcatctacctttttaatggtctttaacggtacaaacgaatcttcttttacccacttggcggacaatttctttttgatcgcatccgccgatattccaagtaggttcccaagagtctctaaatcccttccgaatcctcactcatttttccgggaaccaggcccacggaagaagcggtgcctttccctgcaagaagcagcccgttccggtcaaaaacacttccctctgtgctttgtccgttgataccctcaccttatcggtgcgccccagctcgggaaagatcacgctgtcgttccacaccatctcatagccttttttcttttccttccggaatttcacctgattgctgaagctgatttcccctgcaatactggtaaggctcatggcgtagctgaccgttgcctctccgtctttttcttctacctgcttaatctgggcggttattccggaggcctcgattccttcgtagatatttttatgtctggtgataaaatcctcttccctgatatttatatggctctgttcatccaacatcccatacatagcctgatagtctgacctggtaagacactccacatattccaaaaacaacgcatccggctttttcctagacgctccgaatttcccctgtatttgaaagaacagtgccgctcctgccaggccggccagcaatataacgagtgtgcaaacagtgctgaataaaaatctccttcttctgcgcctcatggcatacctcctgtcaatccgtttgcttaatctgtccgcagattattggacacgccggaagcagtcccggtaaggatatcagcgggatcttccagatgaaagtaataatttaaaattccttttcctaccccaaccacattgccggagctgtaaccattggcgatccgcacggttatggctatctgcgggtcctcaaacggggcatatcctatgaaaagtccgtggtttggccgtgttttggattcctctgctgttccggtttttccggccgcattaacttttaagtcttttaaggttgcattggtttttaccagctcattcatacccttggcaacgtcattccatacgtaacccggaagggatacgttgttctgaagcgttggattaaaggactggaccgtgttgtcatcagtatccgttattttataaataagggaaagatcatagctggatccatgattggcaagggtcgcagtgtaccgcgcgatctgtgttgtcgtatagttatgggttccctgtccgatggaagaagggatagcaaattggtctgttacatggggttctgcttctccgatctcaatgcctgtctttttatccagatccagcagaccggcatattcctgcagcttacttaatcccttcccttctgaaaacagcccatcctcttcggttcccagccggtacgtgatttcagataagtatacattacaggagtttttaagagcatcggcactggaaagtatggtaccgtgacctgaccgcttccaacagcgcaaaggcggctgcaccttatcaaacacgccggtgcataccacgctggtatctgtagtgataactccttcgctcagccctgcaatgaccgttaccggtttaaaggtggatcccggagccgtcagctggctggttgcccggttaaataggggcagggataaatctgctgcaagcttctgatagtaggacgtgtccatctgatttgccagacggttgttatcataacccggatagcttacgcatgccagcacctgtccgtcctggggccggaccaccacagctgacccggaacaaggatttaaagccaactgggcaggagtgatctccagattttttatctttttgcgtatgaactgccaggcattcagctgcccatttaaaagtggggcataatccggatcctcttttgataatattccctgatcataaaggagcttttccacatcctctccggtcagagttccttccgttatcattgcctgatatatcagtaaatcaaaaccggaatctttccttaagccgtccaggatcatttcttcaatcaaacttctgctgttgtcaagtgtcatatatttttcagaagcttccacctggcttaaatcaatccagccatttgcaatgcagtcggaaagatactgccggaagctttgttccttctggtcccaggctctgcttttttcagaaagaattttattcttccttactgtatccaaaagataatcataatagcctttcacttcaccgcttaaggagtcatacccggcccctgagacatcaaaggaatcagaaaatccttgaaaaacctgctctttcttgccggcaaacctttcatagacggccttctccaaatccgacgcatccgtttcctgaaaccggccggtatcaatgacatgattttttattaatgcaaaatacacttcatccgatgaaatccggatctgggaggcatcggctgcttttggcatgtcagcccttttgctctcttccatattggcaaggagaattccggcaatctgctgttccagcatctgataaaccgcattctgcaaatccttgtcaatggtcaggtaaacatcgtttccagtatggggcatactggtaatttccgggtctgatttccggtttcccactacgtccgtataaaactgttccatcccatcctgtccacgaagctgtccttccatagacttttcaattccgccttttcctataatggactggttcgtataaatggcaccatcccgattccctgcttccagttcctcggcggaaaccggccccgtataacccaatatggaagaaaggctttctccgccgtagtagacacggacgtttccctcctggatatccgccccaggcaggctgagtttcttttccagtacttccaccatagcttcctcggatacatccgaggcgaccagataaggaaggtatttgcggtatgaattcagggaaaggccatagcggatgttggctatctgcaggatctccctgggcgtaagggtatggggcagtccgtattgctccccttcctcttctgtataggcatcctcgatcaggaacttttccttgctgcataattttttcatgagttcatccgctgttacggatttttccgcatccgtcaaatcatccacagagttttttccataaaaatctgccttaaaacggctgagcttccacccttcttcggtaaactcataatttccctgttcatccacagatatgggcagaactgtatttaacttgtcctcatccttgaccaggctaatcagctgataggcaattccgtttaaggaccgctggcgttctttcgatgacttgtaattctgggaatcctccagggtaatatcataggaaagccggtttgaagccagtaaatttccgttcctgtcataaatgtttccgcggcttccggcaattctccttgtcttcataatggaactcataaactcttcctgattggctgccccttccatgatctgaagacggtacagccggaaaataagcaccagaaacagaaatccaaaaataacgcccagaaccgccagtcttggtatccggtccaataattgaagtccggaaaaattcttatctttccataatttatgattgcgcaaaatgatctccttttatcttacatttgtaagatttaattatacacggattttgtcctgatgtaaacttttttttaatcatatctgctattgtataacaaaacagcgttccgttcgcgttcaatataagattaacagaaaagccttccaagagtgccgttttaaatcttttactggctgcggctgctaatgacagcatagaaaccaggcagattcagtgtatttttatatatttatattgagaaatacggattcttttgttaaaatttaattaagaatttgtcagatggcctgagtccgctggcatcttaatgaaaagataaaatgggggtagaatcatgaaaaaaatgagacaattaattgttacagctgttctttccattgtaatgagtttttctgcgtttgccggacaatggaatcaggatgccaaaggctggtggtaccagaatgatgacggtacctatccggtagattgctggcaatggatcgacggagatgcagatggtgtctcggaatgctattatttcaatgaatacggctattgcctgaccaataccacaactcctgatggaaaaacagtggatgcaaacggagcattggccatttccggcacagtacagacaaaaacctcaggcaattcttcatcaaacactaagtcaaacagcgataccgcagcagccacgcagccagcacaggatacctcacaaagcactgcagcagttaacaataaggaacagatggtatgggtatccagaacaggcaaaaagtaccattcaaacccaaactgcagcaatatgaaaaatccggcccacatgacacaatcagatgcagaagcattgggaagaactccctgttcaaaatgctattagcataccggtcagccaatcgttatattcagcatttgccgcttccggccacggcccctgtataaaaatatcatacataagagaaacagacggaaagaatatgccgtctgttttctgttaataaatgtatttaaaaaggaatcttcacgccttttatcctcctactcatagaaccacgaaacaaagaataagtataagtaatatttacaggtaaaaagaaaggactgaaccatggcccaaaccgataatttctataccttaaagggttactcccttttagagcatgcgcaaatcacctcttccatggaagattatctggaaatgatatgcaggctccaccgtgacggccagcctatccgcatcaaggagctggcggaatgcctccatgtaaagccttcctcggcctctaaaatgactggaaacttaaggaaacaggggctggtgcgctttgagaaatacggcaccgtatccctgacagaggacggcctggagctgggtgaatatttattattccgtcacgatatcctccgccggttcttctgctatatcaatcaaaattccgacgaactggagcaggtggaaaaggtggagcatttcatcgaaccggaaacagtgtataatattcaaaaatggctggataaatttacatagacaggcttgtgtgattttacaattcatcgtatactatagcataacacgtacatttctaaggaggacaaacacatggataagattaagatgacaacccccatcgtcgaaatggatggcgacgagatgaccaggattctctggcagatgatcaaagatcaccttttgctgccatatattgatttaaagacagaatattatgacctgggcctggaataccgtgatgagacaaacgaccaggtgaccgttgactctgctaatgccacaaagaaatataaggttgccgtcaagtgcgccacaatcacccccaatgcagaccgggtaaaggaatataacttaaaagaaatgtggaaaagccccaacggcaccatccgggcgatcttagacggaaccgtgttccgcgctcccatcgttgtcaagggaatcgaaccatgtgtgatcaactggaaaaagcccattaccatagcaagacatgcttacggtgatgtttacaaaggatctgaaatgaaagtcccgggagcaggaaaggtggagcttgtctataccgctgaggatggcagtgaggaacgggagcttgtccactcctttaatggccctggaatcgtacagggaatgcacaatttaaacaactctattgaaagctttgccagaagctgctttaactacgcccttgacacttcccaggatttgtggtttgccacaaaagacaccatttccaagaaatatgaccacacctttaaggacattttccaggaaatctttgaggctgactatgaggacaaatttaaggaagcaggcatcacctatttctacactctgatcgacgatgcggtggcccgcgtgatgaaatcagaaggcggctatatctgggcctgcaaaaactacgacggtgatgtaatgagcgatatgatatcctctgccttcggctccctggccatgatgacctctgtcctggtatctcctgatggggactatgagtacgaagcagcccacggaaccgtacagcgccactactacaagcacttaaagggcgaggaaacctccaccaactccgttgcaaccatcttcgcatggaccggtgctttgagaaagcgggggaactggatggaaacacagaacttgccgcttttgcagacaagctggaacaggcgaccatcgataccattgaagcaggtgaaatgacaaaggatttagccctcatcacttccattcccaacccaacggcattaaacagtgaggaatttattaagacaattgcaaaaagactgtaaaaactgccataccctaaacccatacggagatgaagcatcggatgacattgcagcagcttaaatattttattgaaatcgtgaactgcggttccatcaataaggcggcggaaagcctatttattgcccagcccagcctgtcaaatgcggtgaaagacttggaaaccgagatcggcgtggagctctttaccagaacgcccaaaggcatttcactgaccaaggacggcgtggaatttctaggctatgcccgccaggtcgctgaacagacaagccttcttgaacagcgctatttaagcgggaagccctcccgccgcctatgctccatctcgacccagcactatgcttttgccgtaaacgcctttgtgaacatggtccagaaaacaaacgcggacgaatatgaattcaccctgagagaaacgcggacccatgagatcattgaggatgtgaaaaccttacgcagcgagcttggcattctgtacatgaacccgtttaacaaacgggtactggaaaagctgctgcgggagaacggtttgacattccaccccctgtttaccgccaagccccatatttttgtcagcgcattaaacccactggcaaaaaaggagtacgtcacccctgacgacttagagccttatccctgcctttcttttgaacagggggagtacaactccttttatttttcagaggagatcttaagcactgccttcagcaagaaaaccatccgggtcagcgacagagccaccatttttaacctgatgatcggccttaacggctacaccatatcaacaggaatcgtaagcgcagacttaaacggtgacaacattaaagcagtgccgtttcacatcgacgattccatagaagtgggctggatcggacataattccatacagctgaccaaacaggcgtccatgtatcttgaggaactaaagcaggtggttgcccggtatgatgttctcatggatgagaagatatagtttataactataacaaagcatagaataatgacattaccctatatgccctcttttgtattacaatgttctcatcagacatttaatccaacatacaggagggcttttttatgagcaaaagatttcaaaccgtcggcagtttacttcgtccggaaaaactgctggtctataaacatcaaattgaacaccgggacgacatcacataccctttctataacgattttccaggatatgaggaatgcgaataccaagcgaccaaagacgtggtggataaagaaatacagcacaattttaggatcatcacggacggcgaatactccaagtccatgtggcatttagactttgtctgggggcttaaaggcatcagccggtacattgctgaccatggctattttttccgggacaaagatgaagttcagaaatacgaaacccgccgggatatcggcctgcgaattacccagcccttaagcggcaggaaccaccatttcattaaagttttccaaaggcttgcagccattgcaggggacaggaaaacaaagctctgtattccatctccgtcccacatctttggagagctttcctggtcagataacatcggaggcaaggattctgtctattccacgcctcaggaattaaaagaagggcttgttcaggcttacagggaatttcttgaggaatacgcagccgcaggcggaaagatcctgcagctggacgactgcctgtgggagattttcgccgatgacaatcccaactctccctatacaggaaaaaacattgatcaggaaacagttcttgccctggcggcggaatttattgacatcaacaacacaatcattgacttcggccacagccttggacttatcatgtggactcacaactgccgcggcaactacgattcccgaaacatgggaggcggctcctacttaaaaattgcccaattgttcttaaaacaactgaaatacgaccggtttttccttgagtgggatgacgacagggccggttcccttgacgccctttccgtatttaaggataaccctcatgttgaaatcgtgctgggccttctttcaagcaaaaccaacacccttgatgatgaagcgcgggtcatcagcctgcttgatgaagcgaccaaaatcattcccaaggatcgtttgttcctctcccaccagtgcggctttgcctcctgtgacggcggcaacgaactgaccgaagacgagcagtgggcaaagatcgatcagggtcaaaaaatcgccctgaaatactggggcgaataatcaatgcagcagggagcctggaaagaaatctgcaggcgtcggcctggtcagctgctttttcctttcaggaggtaatcatactatggaatacacaccaaaagaaatcctgttaaaaaatgggactccctgtatcttaaaaagtcccggcccgaggatgcagctgccattctggagcttatgcgaaagacttcagaggaaaccaactatatggcccggtatgcggatgagatcaacacctccctccagcaggaagaagagtttctttcctccaacttaaaaagccataaagatttaatgatctgcgcagtaataaacggagagatcgttgcaaattccgggatcaatcctattggagcaatggaacgttactcccaccgggcctcctttggcatctccacctgcaaggcatactgggggcttgggatcggctcccatctcctcgctgccatcaaaaaagaagcccgtaaaatgggctacgagcaattagagctggaagttgtatgtgaaaatgaacggggcctggctctttataaaaaatatggctttgagatctacggcaccagggaatactcctttaaataccgggatggaagctatggggccgcctaccagatgatggtaaggctttaaaaaaaactccatacttcttcaaaatttctgttcatatcattaccaagatgttaaacaataaaatcattatataacatcttggtaatgaaagtatccgtctgcctcctctgtttgaccgtgtatcccgctataagccctgacccccgcctaaaagtccttgtaaacaattcccaggaggttacaaataagtttcttaaaataaactggataccggcctgaaagagggtagaatcttgatatcagctgcatgaaccatgtggttttccacaaataaataccaggccttcatcaacctggtattatttgactaatcatcaatcgaacacatccatcccgtgaatcggaagaatgcctaaaacctgttcccgcgctttttttacagcctccgcatcggcatttataattccctcataaatcttatcatgggtatccgaaagcgtttccagtgaaaccccagcatcatgcatccgatgaacacgggcatttaaaagccgggtgatatggcgccggatcaactgctggaccataaaataaatatccttatacaggctgttatggctcattttcaccacttcataatggaatgcaaaatccgcatccaccatttcctccaggcattctgcattgtctatatttttatgaaaaatcctctgcttttcatgatattggtccaaaacatctttcagcctctgcttctcttcatttgaggcttttataattgccagattcatgcattcgccctccaacaagttcctgagctgctgtacttccccgtattttttatcatcatcataaaactctgcgatttcacttaaaaacgaacgcatggaaaatgccttcacaaacgaaccctctccaacacgggtttcaatgattcccagtgtattcagcttctgaagagccatcctaacacttaaacggtttaccccaaacatctccgcaaactctgcctctgacgggatcttttctccttccctccagacttcgttcacaatgtcacgctttatagcatctcccacctgatccacaacggacaaacggctgatttttgttttccgtgctttcgtctttttaatttccatgatcataccatccagttaatattttaaataactttaattgtatacatttcttacattatacataactgttttctgtttgtcaaaaaagaaaagcggtctcttcacctgtattgggggtgaagagaccgcctgctattcctgtcagaatcacatgggattcatcaggcaatcaccacttttttcgctcttgccatttcttcctcgctcatctcctgtccgatacccggaagctccggaatttcaaagaatcctccggacggctgataattgtggataccggcgtcaatgcatggttttgtcagtgccgcattgtgatgctcatggatgcagaaattgggaatcgctgcctcaacctgaagagccgctgccgtagcaatagggccgccgcacacatgaatctggacaccgatgtcataaacctgagccatatcacatattttctttgtttccgtaattccgcctgtattacatagatcgggctgaataatgcttaaggttctgtcctcaaagaactgacggaatccccatcgtgtatagctgcgctctcccgttgcaagaggcagggagcagctttgtttgatgtgcttaaacatatccggattgcaaggcatggtaggctcttcatagtacataatccggtacggttcaagggctcttccaagctctgacgcagtgttggcatccaacagagagtggatttcaacaatgatatccaaatccggtccgccggcctctctcgctgccgcaatccggtccacggccagctgcagatcatgctgtctgaaggaactgcggtgatgggttccctgtgacgcaaatacctccgccagtcccttcggctcatagggtgcgaataccggatcaatcttcaccgcatcgtagccatcagccatagcctcctttacaacagcatagtaatcttttggatcatacagcagtcctaaggcgcctgtctctccaatcagtttcttccacccgaactgaagctgactcgcgtatgaacggagctttttattcgtctttccgccgataagcttatataccggaagcccaagggacttgcctttgatatcccagcacgcagtatcaatcgcagccattgcagacgtcacaacaactccgcctcccattccccagaatgtatgacggtgcaaatgctcccatatttcctctgtattgaaaggatccatacctatcacaagctttgcaaaatcctggcattggccgaaagccgcctctttgcagtttccataggcaagtcccgcttctccaaaaccactgattccggcatccgtattaactttcacggtaattgcataacctagataaacctctatactcgtaatcctcatgaatttttcctcctgaaacatatttatttgacagttgtcttggctatataatgttcaaaacagtactcggacaattcattgcctatccccggcgtctcgggaacggtgaaatagccgtgtaccggctgcaaatccagttttccaaagtttttgttgtactgatggcggttaaaaacatgatgctcatggatacagaaatttggaatcaccgcctctaagtgtaaggctaccgctgtggaaatcggacttgcacacacatgagcctggacagacacgtcatagacgtgagccatgtcacatattttctttgcctcggtgacaccgccgcagtttccaatatccggctgaatgacctggattgactggttttcaaaatacggcgcatactgccaccgggtatacagacgctctccgtgggcaatcggcatctgaagtttttcacaaatatatttagccgtctttggagttggggtattgggctcctcaaaatagaaaatgccgtatttctggacaatgcggcccagctgaaccgctgaatttgcatccggaaaagagtggttctccatgataatgtccacattcggacctatggcctcacggacagctgcaaccctctcctctatcagctgggtataatagggctttaacaaagtgactgattccagctcattgttgaactttcttccatccctgtcaaacatgaagaaatctatcttgattgcatcgtatccctcatccattgccatctttgcattttccacatactcttccgtctttgccgccatttcataatggtcgctccatccaaactgcagctgactggcataggaccggagtttatccctcttctttcctccgagaagcttataaagcggcacattaaaatgctttgcttttatatcccagacagcaatatcaagggcactcataccggcaaaaataatcgggcctccattttgtccccagaatgtatttttatacattttatcccacatgacctcattatccagcggatccatcccgatgatcattttcgccagatcacaaatcatgctataagcggcgggagcgccggtacaataagcaattgccgcttcaccatctccgtaaatgccttcgtctgtatatacgcggcataccgccggacgccaggacggattattttcaccttccagaagcattacatcgaccttcgtaattttcatagtattacccttcctttcctttttttaaatgccgcagcagaaatacaagcggcacaatcttacctgttatttcattaatcttccgcccagacagaggtatgaatctcaatatttcccgactttgcacgccaaatgccaataactgccattaccagcagagctgttatatttgccactgcgagagacatattcattgacagacaggctttccagaacacaataaggaagcaaaccaaagatacaacgcagactgcatagtacagtccggccgagatatgaaaacgggctttcttccatgcctccggatatttcttcggcatttttatgtatgcaacaaaattgagaaaggcaaaaaatgaggtgaaaagctgaaccatatttgtgataaccgtaatggaaagaccaaataaaatcgggattataccgagcgcatacataaaggtcaaaatccatatgcgggcacctttgccgttcttctttccaaacgaaaccggaagccagccatcatcacaggactggccgattgtgatggagttgtaggcaaagctggaatttaaggtagaaagtaatgccataatcggccctccgataatgaatgcataaaagagccatgccggaaagatacgctgtgctgcaaacaccagtgttgtggaattcccgtattcctcaatgctcataacgcctgttcccgccagcgcaacgcctacgtacagtacgaggagagtaggaactgccatgatcagaacaaccggaatatcttttctggcattctttgcgtcacggccataagcggttgtcatatagtagccctgacaggaataaacaaagagaagcactgcgccaaaaaagcctccattgatctgcccgtttgcgaatgtaattccccagccattcaccaaaaatcccggatctgtaaaatcaaaaatcggcagtttcatcttaacgatgccggcaaccgaaaaaatcaccagtgccgcgatcagcagccatgtcatcattttctgtgctttggccatgatatcaatccccagcaaattgaccacatagaagaaggtcaaaagagagattcccacaatgatccgtggcccccgtccccctaataccggtataatatcccccagatatgcggaagcagacgctccgaacagggaaagcgaaagacattgtgtcagataagcaaatgcgaaaataccggaaatcgtgggacccgctaaatcacagagcatggagtagtttcctccccaagccttaatgtggaggatataaaaatattaggtgcaatcatgacaaatcccataatgattgcggcaaaataggctaaccatgcagaatatccggtcatcttgattgccggaacaataagggtaattacaccagctccgattacctgcccgattgccagcgcatataactctatccttccaagagttcccggcttcggattcggttcttttacaatttttattgccataatgtttcctccgaatttttcaaattatcatttcatcacttcttctccactgatttataaagaattgcatgattgattgcggactgtaaaaattcgtttccaatccctggacattccgggacagtgaaatatccgccttcgggctgtaaattatattttgtaagatttagacaagtttccatacgattgcacgtatggtgctcatggatgacaaaattgggaatggtacactccacctgaagagccgcatttgtagcaagagggctgcctgccacatggatctgaataccggcatcataggcatgtgccatatcacaaatcttctttacctcggagatgcctccgcagtttcctatatccggctgggcaagctgaagcagattgcgtttaaaatgatctgcgtactgccagcgggaatacaatcgttccccatttgcaattggtactgaggtatactttgctatgtactcaacagtctgggctgtaggcgtattgggctcttcaaaagccaggatattgtatttctcagccagtctcgccagctgtaccgctcccaacgcatccgggtaagaatgattctccataatgatatcgacctcatctcccgccgcttcccttgcggccttcatacggctctctaccattttgaactgctttggcgtcaaaaatcctgtcgtatcaagaaagcttaaaggtttcccctcttcatccctgtcaaaaaaatctatcttgactgcatcaaagccctctccgacggcaagcctcacattataagcataatcttccggggtaactgcccacagatgcccggacacacctgtctgcccccagccaaactgaagctggctcgcatatgtgcgaagcttatcccgcactttcccgccaagaagctggtataccggaacattaaagtactttccctttatatcccagagcgccacatcaatagccgcaattccggagaatacaaccggtcctccattctgtccccagaaagtctttttatacatggtctcccaaatcagttccgtctgcagcgggtccattcctgccaccaattcagccagatcacaaatcatgccgaatgcggcgcttcctcccaccccgtaggccatccctgcttcgccgtcgccccagatgcccgaatccgtgtgcacgcggcagccaactgggctgttctgcctgctgttggctgttggaagacggaatacctcaatcttggtaattttcatctcgcaatcctcctttttattatttcatttatataatcactacatcatttattcacttgttcgctatgtgaacattataataagttcgaattgatttgtcaattcttttttgtacattttcaatataataatttttatttttatttacaaattatgcacattaacataagaaataaaaaacttcgttttctttcttgctaaattctaccgatttatggtacatacttaacaaaaccattgactgcctgtatgattccttgaagttatcttaaaaatgtaatagcatgtttctcagcaaataaaatagacggaaacagagtacatggccaggtacactcatgaattcaatgcttccgtctatttgaagatattaatataacaatattttctatatttttctaaaaatccctgttcatctcattatcaaaatgatataatgaagattattatataacatcttggtaatggaaggatctttgacatgaacttaagacatctgactatctttaaaacggtgtgtgaagaaggcagcatcacaggagcagccaaggcgctgtccatgacccagcctgccatctcccacgccatcaatgaactggaagaatccgttggctcgcctttatttgaccgtgtatcccgcagagtggtcatcaatgagaacggaaaattttatttgtctaaggtcatccctctcctggaactgtatcaggatctggaaaactattccggtgccctgcatcttcaggctcctttaagaatcggcgcctgcgtaaccctggccacctacttacttcctaaagtggtatcccgctttacccttacaaaccctgatacccagctaaaggtgatagtaaacaattcccaggaggttacaaacaagcttcttaaaaatgaactggatatcggcctgattgagggagtcatccctgatgagaaattggagaagatccccttttcctcctatcccatggcagtcatctgcgcccccggccacccctttgcagaccgtcttgcccagccggtggcactggaccggctcattgaagaacctctgctgctgagagaacagggctgtacccttcgggatacctttgacttcgcccttgccttaaacaatttatcggctgaacctctctggtccagcaccaactccgatgtgatcctccaggctgtaagggagaatatcgggatcggcattgttcccagaatttttgccgatgagtccattaaaaaaggggaaatcgtagaaatagaggtaaagaatctggatatcagctgcatgaatcatgtggtattccataaggataaattccagacggaagcattccaggccttcatcaacctggtattattcgactaaggacggttaccggcagaaggagttttgccggatccctgtgacttcatataatccttcacaaaatccagaaatacttcatcaggaagagataagggctgatccttatgaaacaccgcatagatcttcctggtgaggcttatggagtctttcagcttcaacaccttgatcaccccatatttacgttctgtttcaattgccagaactgacaagatgccgattcccttattatccaccacacatttcttcactgcctcgatgtttccaatggcgtggatgttctttttcggaaagtttaagcttccggcagattctaagtacttaacaatggatgaccggggattggttgtcatgagattctctcccaccaaatcctccagccccacctcatctttcctgcttaaaggattatccgttgaagcgaaaaagacaagcgggtcatccgtcagctcctcatacaacagcatctctctttgaggaggaaacggctggctgacaaatccaaaaggaaaggcctttgattcaatatcctcaaaaacattctgagtgtattctacgtggttcaccacggtcacagacggatatttggctgaaaatgcatgaatgatgggtggaaagatataggttcccggggtgccggaacaggcaaaccgtatttccctgttttttaagttctcagaagcatagatctccttctccgctcccctcatggtctccatgatggtcttcacataaggaagcagcagcttcccttcttttgtcaatcctatccggttgttatccctttcaaataattcggtcccaaaatgcttttccaggcttttcacacgtatggaaacagccgcctgggagcagaacatctctgcggcagtctgggtaaagctgtggtttccggcgactttcagaaaggtttccagggtttccagattcatcatcattctcctttcagtctcttgcataaaatatatttatggagattatagcaaatccacaaatttatgtcaatttttctattttaaataaacattattcctaacctcataagattaatttataaaatcatggattcctcccctgaaaataaaatgaatataaaaatctatcgttgtactttttccaactaaaattttacacttaggctacaataagatattgtgagaaaggagatgttgccatgaatgaagcaaaagcaacattgtcaacgcaggaagtcaaagtaaaaaaagtcaaaagcccttttgaactgaaaatgcaatttttcgggctgccggccgcattgatcgtattcggccttttctattccacccccatccctgtgggcctgtcctatgcaggaaaaatggccctgggcgtattcttgaccgccctcatcctttgggtcacggaaagcatccccaattacacggtttccctcctggtcatcgtagccctccccctccttggcgtctgggaagaggaaaaggccatgggcgtattgggctatgaagtcatctggctgacctttgcagcctttatcatcgcctcaggcatggaaaaaagcggccttgccaaacgtcttgcccttaacctcataaccaggttcggcaaaagcgcaaacagcatcctgctgcttttaattgccaccaactttctcatcgcttttgtggtgccttctaccaccgcccgggcggcaatgatgttccccatcgtccttctggtgatcgaagccttcggaactaccatgaatgaccctaagaataacttgggaaagcttctggccttacagggaatccagtccaacaatttgtccacaggagccattgtaaccgcaaccagcgcccagatcatggccattggttttattaaggatttgaccggacagaacatttcgtggacttactggttcattgcctccgcccctgtcaccatcctgaccctcctggcctccttttttatcggaaagatcctttttaagattcccgcctccaatgccaaggtaaacttaagccttctggaagaagaacgtaaaaatcttggcaagatgagtctggtggaaaagaaagctttggtcatctttgggatcaccatagccttatgggccattgataccagacagatccatcttttcgggttccagctcagccttgttatggtggccattttatcggcggcattgttcttcatgccctatcttggcattctgaaatggaaagaggccaaaatctcctggaatctgctgattttcgcctgcggagcttacgctgccggcgtggcattggatgaaaccggcgtggctgcctggggacttaacgccctgtttgcacacttaggcatagagagcatgagctttaccttaatatttgccgttatcatgctcattgccagtttcagccacttcatctttacatccaaaacagtgcggaccattatactcattccaaccatcatcggtattgccaatgcaaccggaatcaatccggtggccctggctcttccggccgcattttgtatttccgacacaatcactttacctcctcacagcaaagtcaacctaatctactacaacaccggctttttcaatgtgcttgaacagctgctttacggcacgctggttctgttggcaaaatgggccctgatgatcatcgcctccctgacatggttccggttcatcgggctcgtataagcggattcagttgcataccttaacagaaaggaacaaaaccatatgaaagcaatgaaaaaattctcttatctcttatgctcatgcctgtttatcacactggctgcagcacacaccgcctacggaggcgacgccggtaaagtggtttccatggaagacaggattacccctgacggagaagacggaatcatcacccagactataaatgccaaaaccaatgcttcaggagaggtcatctttcctatttggaaggatgctgccattgaatccataaaagccatttccggcacactggcagcggaagaaattaaggaggaatcagacggcgaccagacttataatcaggtggtatttgaggaaaaggaaactcaggtctctttccaggttgttttacggggagaagggctttacgcaggagaagacgcggatttaggtgatacctatcccggcaatgccaaagaactctcttttaaagccaaaaacaccactcccttatccgtcggctcataccagatgaaaatcgctgtccccaagggaaaagagcttcttaatattgtggattattccgataaaaaaccttttaccatcaccagcgaagatggatatactttcggaggatttgatttcggaaagatttcccctggaaaggaatcaacccttgccatcaacgtgttcagcaaaaaaagcggttcctccgctttcctgtggatgatcatcgtcatactatcggccgggttcatgtaccgcaatctggacctgcttaaaaagccggtcaatcaataaactgaaaaaaggatgagtgattctatgagaaaaaaacagggaatattgattatttctgatggtctgggtgaccggccaatcaaggcgctgggaggtttgaccccgctggaatatgcaaatacaccgaatctggaccgtttggcaaaagaaggctgcacaggaaacgtttatcccatcgccccagggatacctgttggcacggatgtggggcacatggaaatctttggctgcgattcggatatgtactaccccggcagaggaccgctggaggctttaagcggggaatggagcttatggaaggagatgtagcctttcggggaaatttcggaaccattgacgaggaaggcattgtcattgaccggagagccggccggatccaggatggaactaaagaactggcaagggccttatcagggatgcagcttaaggatggcaccattgttcttgtaaaggagctgacccagcaccgggtcgctgtggtgcttcgtggaaaggggctgtccgcggcacttgtgcccacagacgtaggaactgccaacgaaggagcaaagctggtggtacctcacccggaagatcctgcctgtaaagaagctgcccggacagcggaaaacttatgggaattcaccaggaaagccattgacatcctaaaaagtcatcctgtaaaccaggatcggatcagaaaaggactgctgccggccaatgtgatcataacaagaggacccggacagctgagggccatccccagtacggcccaaaaagccggcatcaggggcctgtgcatcgcaggggatgttactgtaggcgggatcgccaggctggttggttttgattattacttccaggaatcctttaccggtggttttaccacggatatcatgggaaaggccagaaaagctgcggaatccttaaaggaaggctacgactgggtcatcgtccatgttaagggcactgatttagcaggccatgataatcagcccttggaaaaggtccgtatcattgaagagatagactgtatgataggctatctcatggatcagattgacaaggataattgttacatcgcctttacggcagaccactccactccctgcgaggccagggaccatacgggagacggcgttcccaccatgatctggggctgggacgtgaggcgggataaggtggaaaaggcaggagaaacctattttatggaaggcgccctgcaaaacttaagggcaagggatatttttgcccttcaaatggacttaatgggcttttcaaaaaagagaggagcctgatccgtctgatacaaaaggaagcgctgaaaaatgacgaaaccagggtcatttttcagcgcttcttttttattcttctttttatgctactttttatgcttctctctcagccagaatcttgtctatgctgacgatcttcacacaaagagcaaataattccatagccaggatcagatcagataaaggaggataagagggggctatacggatattgttatccctgggatcctttccataaggataagtggctcctgcaccagtcatcactaagccggattttttgcatcttgccacgatggactttgcacatccgtcaagggagtcaaaggaaataaaatagccgccttttggactggtccattcaccgatcccaagaccgcccagctcctgttccaggatctggatcactgcctcaaatttcggcctcatgatgtccgcatgctttctcatatgctctaccatgccgtggatatctccaaagtagcgtacatggcgcagctgattcaccttgtcatgtccaatggtctgaatctttaactgcttcataatgtctaccaggttgttctgactggccgcaatggctgcaatgccggagcctgggaagctgacctttgaggtggaagcgaatttataaaccatatccggattcccggctctcttacactctgcaaggatctcaatgagatgatcctgatcccggtcgtataagtgatggatggtgtaagcgttgtcccagtaaatgcggaagtcttttgcagccggctttaagcgggcaaaacggcgcaccgtatcatcggaataggaaattccctgagggttggaatatttgggaacgcaccagattcctttgatggaatcatcctttgcaaccagttcttccaccatatccatatcagggccggtgggagtcatgggaacgttcaccatttcgatcccaaagtattcggttatggaaaagtgtctgtcataccctgggacaggacaaaggaatttcaccttatccagcttgcaccagggagtgctccccataacgccgtgggtcatggaacgggaaaccgtatcatacatgacatttaagctggaattgccataaatgatgatatggtcaggcgcaacctccatcatatctgcaagaagctcttttgcttccttgataccgtcaagcaccccatagttgcggcagtccgtgccgtcatcacagatcagatcaccattgctgctaagcacatccatcattcccatggatatatccagctgttccgtgctgggctttcctctggacatgtctagctttaaatccttgccctgaaactccttatactgcacggaaagcagcttcctcagttcctgtaactcttcctttgtcatctcaacatacggcttcatagatttcattttcctcctcatatagactcctttaacccaataggttctttagtatcctgttgaccgctgccggatcggcttttcctttcatggaacgcatggtctggcctaccagaaatccaaaagccttctcttttccattgcggtaatcctccacggactgcggattagcggaaacaattccctcaattaccctgcgcagttctccttcgtcattgacaacctttaatcctttttcttccacatactgttccggatcaacgttttctgcgaaaactttttcaaaaacttccttgcccacggtacggttaatggtaccattatccactaaatcaatcaattttgcaaggttttccggagaaaatgtcatattctcaggttccgtttccgtctcttttaagagccgcatagcctccaccatgagccagtttgcagcctccttaggcttcccgcagatggctgtgaccgcctcaaaaatatccgccatatgcttggaacctgtgataatatccgcatcatatggggaaagcttgaactcctcctgatagcgtaccatcttttccgtccgcagctccggctgcctggcctttatgctgctgatccattcatcgctaatgaccacaggaggaaggtccgggtccgggaaataacggtagtccttggcatcttccttgaaccgcatggcataggaggattccttgttgtcatcccaccgcctggtctcctgaaccaccattttttcttcctcgatcaattcgatctgacgtttcctctccccttcaatggcacgggcaatggccttaaaagagtttaaattcttcatttccgtccttgtgccgaactgggccgaaccggcctcacggacagataagttcacatcagccctcatggagccttcctgaagcttgcagtccgaggcgcccagatactggatgatcagcctcagcttttctaaatatgcaattacctcatccccgtttctcatgtcaggctctgatacgatctcaatgagagggactccgctccggttaaagtcaaccagagagcagtcctcccactcatcatggatgagctttcctgcgtcctcttccatgtggatttcatggattccgattttcttctttcctgccggtgtatcgatttccacatagccgtcgtgacagatgggaaggtaaagctgggatatctggtagttctgcggattatcagggtaaaaataattcttccggtcaaacttgcagaactggttgatctgacagtttgccgcaaggcccactgccagggcatattccaccacctgcttattaaggacaggaagggaaccgggcattccggtgcagaccggacaggtgtgagtgttgggggctcctccgaattccgtggagcaggcgcagaagatttttgtttttgtagccagttccacatggacttccaggccgatgactgtctcatactgtttgctcatttacctctcctcctttcctgccaatgtatccagggcagagcttcccacgctattgggggtgtaaagggatgcctccggagtgtttccggaagcagcgtcttctgccattgggggcatctcatagcttctgctctgctcaaaggcaaagcccgcccgtatgatatccttttctttaaagcagtctccgataaactggacaccaataggcaggcctcctaaatccctgccgcagggaaccgtaagtcccggaagcccggcaagatttacggaaatggtataaatatcccccagatacatctttaatggatcgcttaagctttctcccagccggggcgccgtggatggggaagccggcccaagaatcacatcgtattttgaaaatgcctggtcaaatgctttcttgatcaatgcctttgttcttaatgccttcaggtaatatgcatcataataaccggagcttaatacaaaggagcccagcatgatgcggcgtttcacctcagggccaaagccctgggaacggctctttttgtacatgccgtgaagtccttcgtattcctttgcccgatagccgtatttcacgccgtcaaacctggataagttggagctggcttcagcagaggcgatcacataatatgccggaatggcatattccgccatacccaagttaaaggtctccacaacagctcccttttcctctaataccctggcggcttttaaaacagcctcctttaccggccggtcaaggccctcacccagataatcagacggaatgccgatccgcatcccctttacatcatccgttaaagcctgggtaaaatcataatcattccgctccacagatgtgctgtccttctcatcatgggaagccaaaacctccagaatcgctgcgcaatccgtcacatcctttgcaacagggccgatctggtccagggaagagccataggcaatcagcccgtatctggaaatagtcccataagtgggctttagtcccgtaactccgcagaaggatgcaggctgccttatggaacctccggtatcagagcctaaggcatagaaacattctgcagctgcaactgctgcacaggaaccgccggaggaaccgccgggaacgtgctccgggttccatgggtttctcgtgaccccgtaagccgatgtttccgtagtgcttcccatggcaaactcatccatgttggtttttccaaggatcacagctcctgccttgattaaatgttccacggctgaagccgtataagcaggaacaaagtttgaaaggattttagaactgcaggtagtcctcataccttcgatgcagatgttatccttcaccgctaccggtacccctgccaaagggcctgtaagctccccggcttggatccgtttctgcacatcttccgcctgctttaatgctctatcttcctctattgacacaaagctgttaagcaccggttccatggccttaatctggcccagggctgcttttaccgcttctggggaggtaacctcaccgctttttatttttttccctaactgtaccgctgtgagggataatatttcttttgctgtcataaaaaatccccctattccactgttttcggcaccttaaaagctccatccttgctttccggagcatttttcaagatgttctctctgtcgtcgccgttttccaccacatcttcacggaaaacgttgtgtaccgggaatacatgggacatgggttccacgccggccgtatccagttcgtttaatttatcaatataatccagcatgcggcccatatcctttttcgccgcttccttttcttcctcgccaagctccagctttgccagaatcccaacgtattcgatcatatcatcatcgattatatgcgccatcttttccttcttcctttcctctttacagcccatgtattctgggcataaaggtatacccgcagggtgtttcctctttcctgctcacgctttctgagcgtaaagatatacccgcagggtgcctatggttccagtcttgtcacatctcttggaaacaacgtggtctctcttatatttccttcgtcaagaaggcgcatggttaagcgctccaggccgatcccaagacctccgtggggcggcatgccgtattggaatatcattaaataggaagaaatgtcttccggattcatgcctctggcctccatttttttaagaatggtatcataatcatgaattctctggcctccggtggtgacttccagacccttgaataataagtcaaagcttaaagtgaatttagagtctgtaggatcatccatagcatagaaggggcgtttttttgacggatagtgggtaacgaatacgaaatcgctgccatactcttccttgaaataacggccgatgagtacttcctcctcaggctctaaatcataggggtttctgatttttctgttatattttccggcaaccagttcctttgctttgtcaaaacggaccgtgggaatattggacacattgggaagagtgaccttaagcatcttaagctctgtttcatactcctcgcaaagaaggccaaaggtatactgcagcatggctgtttccatttccatgatctcctcaaagctgtcaatgtatcccatttcaaagtccatgctggtatattcatttaaatgccgtgttgtattatgcttttccgcacggaagacgggagcgacttcaaatacccggtcgtacacgcctaccatggtctgcttataaaactggggactttggcccagttctgctttcttattaaaataatccagtttaaatacgtttgagccgccttctgctccgcgggccacgatctttggtgtacggatctcggtaaagttctgggagtgcagaaagtcccgaaaccctcttacaatgccttcctggatgcggaacttcgcccgttccattgggtttcgtaaggtaatgggccgcagggacagctttgtctcaagggaagtatttaatttccacttgctgattgccacaggcagcgcttctgccggctgggacagcaggtcaatctccgaaagccggatctcaaacccgtgaggagctctctcttcctctgatacgattccggtgacccggaccgcagactcttcctttaacaggcttaagtcaaaattcgtttttccttcttcatatacgcattgtaccagaccttctgctttccgaaggatcacaaaagcaacctcacccatatcccttatggtatggacgctgccttccatttttactgtccggccctggtaactgccggatccgatctggtccatggagaccgtttctttttcttttacaccactgataaattccatatctgtattctccttacctgaatgtaattgttttgattccggtgaaggggttgttgttgttctgccatgcattcatcatctggcgaatacaagaaatttttaaacggcaacaaaatatcccgccccggaatacagttacatattccgggacgggatttatatggctataagttcccgcggtaccacccgcattgagacaactgcctcttcctccagccgcagatatgacagccggataagcaaatgcctccactcaaacatttaacgcatgtgtacggataagcctactcatgtcacagtcaatccaattaaaaaggatttcctgccgcttcggcatatcggctccggagtgttcccttagccaagtcccacgtgacggcgctctcagtcggtgacgccctcttcctgttgaggtccataggccagagtctccttctctgcctttctcagtatatcttctgaattcctgtaggttcatgattccctgttcagacctgttttataacagttcatcacttcactataatgaattgcacttataatatcacaatctattttaccgcgcaatatttatttttcacaaattctctccagcaatggaaaaagaacctaataaatcatacaatgttgacttttcatgtcgaaaaggttacaattatgattatgcttactataagaatagggggctttttttatgtctgaaacaaccgctgctttaaggctggaagaaaataaaatgggaacaatgccggtaaacaagcttttgcttaccatgtctcttcccatggtcatttccatgctcatacaggcgctttataacgtggtcgacagtattttcgtggctcagataggggaaacagcccttactgcagtctctttggcatttcccattcaaaatctgatcattgcagtcgccgtaggaaccggtgtaggagtcaatgcccttctttcccgatccttaggggaacagaaccagaaagcggccaacttagcagcagtcaatggaatatttgtttttattctcagctatctggtcaccgccctgctggcaattttcttttccagattttattttacggtgcagacaggcaacgaggagatcatcagccagggaaccatttatctttccatctgtaccatcttctccttcggcgtttatttagaaatcgcttttgagcggatcatgcagtccaccggccgcaccatctacaacatgatcacccaggggcttggagccatcatcaatatcattctggaccccatcctcatattcggacttttcggctttccccgcctcggcattgccggagccgccatcgcaaccgttatcggccagatcatcgccatgatgctcctgctgtattttaatttaaccagaaatcctgacgtaaatttaaatatgcggcgctttcgccctcataaggaaaccattgtgaatatttataaggtggggcttccatccattatcatgcagtccatcggttcggtcatgacctttggggtgaataagatcctccttttgttctcagaaacagcagtctccgtattcggcattttctttaagctgcaaagcttcatctttatgcccgtattcggactcaataacggtatggtccccattgtggcctataactgtggtgccaaaaataaggatcgtatcatgaagaccattcgttccagcattatcggatctgtctccatcatgttcctgggagtcatcatcttccaggtattccccaaacagcttttacttttgtttgatgcttccgagcacatgatttccatcggcgttcccgctttgcgcatcatcagcttagggttcctctttgccggctacagcattatcgttggttctgttttccaggctcttggtaacggcatctacagcctcatcgtatccgttgccagacagcttgtatgtattttacctattgcatatatcttcgcgaaagtttttggtcttcatgcaatatggtatgccttccctctggccgagatcatggcactggttttaaccaccatcctgtttaaacgaatttacgaaaacaacatcaaaaaactttaggttttcacagaggttatcatatgagttccgattatctgctagtagacggctacaacatcatatttgcctggccggaactgaaagaattggcggagaccaatatggactccgccagaaccaggcttcaggatgtgctctgcaattaccagggctataaaaaatgtaatgtggttcttgtctttgacggctacaaggtcaagggaaacccgggcactgttatggaatatcacaacattcacgtgatttttacaaaagaagccgaaactgcggaccagtacatagaaaaagtctcccaacagatcggcaggcagtaccaggtgcgggtggccacctcggacaagatggaacagatcatcatcctgggaaaaggctgcacacgcctttccgccagagatttaaaaaaagaaattgaggatacaaattctgaaatcaagaaggaacatttagaacggattccctcaaagaaaaaccgcctctttgacaacgtagacccggagctgtttgaatatctggaaaaaatacggctgaataaaaaggattaggcatatatttatattaccgtaagccaaaaaacgctttcgataatcggatggacggggcaaaatacgcccttttatcttcacttgcatggcaagttcagataagttataaaaccaatacacaggaggaatatcacatgtcactactggaattgttcatcatcgcggtagccttatccatggatgcctttgcagtttccatctgtaaaggattatgcatgccaaagatgaactggaaccatgcagtcattgcaggcctgtatttcggaggatttcagtccggaatgccccttataggatacctgcttgggtcgcagtttaaggaggccattacctcctttgaccactggattgcatttatcctgcttggagccatcggctttaacatgataaaggaatccttcagcaaagaggaggaagaatgtgaggtttctcccatggccccaaaaacatgatcccattggcagtcgccaccagcattgacgcacttgcagtcggcgttacctttgcatttctccaggtgcagatcgtcccggcagtctcctttatcggaatcaccaccttcactctgtccatccttggggttaaggttggaaatgtatttggtacacgctataagtcaaaagcagaatttgccggcggcctgatcctgatccttatgggggtcaagatcctgatacagcacttactggagttttaagccttttcacagaaatgcagcataaccgcgccaaaaggttccagaacaagctttttctccttgatctccgggctggcacagttggataacaaaatttcccagccctccagtgtctcatttccttcaatctcctggctctttccggtgaaattggcaaagaccagaagtctttctttctgccagcttcttttataggcaaatacccctttctgcttcaccaaaacaggctcataatttccttcgctgatcaccctgcagcgttttctcagcccaatcagcttctgatagtagaaaaataccgaatcaggatcagcaaggctttccctcacattgatctcttcatagtttttattcacatcgatccaggggatgcctgtggtaaacccggcctgtttccctgactcccactgcatgggggttcttgcgttatccctggaccgttctcttaaaatccggtaaatatccttttcttccattccctgttcttttaaaatgtcaaagtagtgaaggctttccacatcacgatactgggagatatgggtgaaataagcattagtcatgccgatttcctctccctggtaaatatagggcgttcccctcatcccgtgtaagacggttgccagcatctttgcggtctgctttctcttctctttgtcatctccgaatctggacactgctctgggctgatcgtgattgcaccagaataccgcattccacccgttttcctcagccattgaagcctgccatgtatggaaaatctttttcagcttttcaaagtcatagggcatcagggaccatttgtctcccccctgataatccacctttaaatgatggaaattaaaacacatcttaagctgtttttcttccggattggtatagcggacacagtggtcaatggtggtggaggacatctctcccaccgtgatgatttcatcggcatccaggcctgtatccaccacaatttcctttaaatactcgtggatccgggggccatcggtgtaaaaccggcggccgtctccctcctcatcatcttcccaggcggatggcttggataccagattgatcacatcaaaccggaatccccgtatccccttttccttccagaaacggatcactttttttatctcttcccgcaccatgggattttcccagtttaaatctgcctgggtcttgtcatataaatgaaggtagtattttccaacttcttccgaatactcccatgcactgcctccgaattttgactgccagttggtaggaggattccccggcgtcccttctttaaagaaatagtaatcctggaaccttttatcaccttgaagggccttttgaaaccactcatggcttgtggaggtatggttaaaaaccatatcaaacatcagccccatgcccagctctcctgcctttgcaatcagtttttccaactcctccatggttccaaacagaggatcaatccggcagtaatcctggatatcatacccattgtcattttgaggggataagaaaaacggagtcagccaaaggtaatccacgccaagcatctttaggtaatccagcttttccaacactccccctaaatctcctgtcccgtctccattgctgtccataaaggatttggggtagatctgatatacacatgatttcttaaagctctccatttactcgaatcctttcttctttccaagtattactgtcagcgcaaagggcactgcaacggcaatcagcatgcaaagtccgaatattcccatatactggggctggatggacaggattcccggaaggccgccaactccaatggaatttgccataacattcattccacggaaattgtagcagctatggcggaaccgatcatggcagaaaggaacggaaagcccctctttaaattcacaccgaacatagcaggctccgtaactcctaagtaacaggagatgcaggcaggaatggagatctgctttgcttcctcattctttttttgaaggtacatcattcccagaaccgcagaaccctgggcaatgtttgataaagcgatcatgggccacagcatggttcctccgaattcagccatgagctgtaagtcgatggcgtttgtcatatggtgaagtccggtaataacaagtggtgcatatacaaatccgaataaggttgcgaacagccagcggaagctggaggtaagccctgcataaacaatcttggaaatccaggaaccaatggcccagccaattggccctaccactgcatgggcagcgatcacagcgagaagcagggataaaaatggaactacgatcatggaaaccgcctgaggcgtgatcttcttaaagaacctttctaagtaaaccagcacaaatcctgccagaatagccgggatgacctgggcctgataaccgatcatctccattttcacgaatccaaaatcccaaacaggcacttctgcccctgatgccattgcatatgcatttaacagctggggagagacaagggtcagtcccaggacaatgccaagaatctgggttgttcccatctttcttgtcacagaccaggtaatccctaccggcaggaaatggaaaatggcttcgccaaggagccaaaggaagctatggacacccgcccagaactgggacacagcaacaagggtttccgttccccgttcacaagcttgatctctcctatgatgttcctgaaacccaggatcagacctcctacaatgatggccgggatcagcggagcaaagatttctgcaatatccgccacaccccgctgcagaagattcaaatttcccttggcctcttttttacttcatccttggatactccttccacgccggaaatggaaacaaagtcattgtaaaaggactgtacatcatttccgatgatcacctgaaactgtccggcctgggtaaaggtgcccttgacgcttgaaagggtttcgatctgctttgtatccgcttttcccggatcaaccagagcaaaacgcatcctggtcatacagtgactcactgccccgatattttccttgcccccacatactccaatagtttccttgcatcgctttcatacttacccatattcatactcccttcatacatgtttttagcatccattgacttatatgtttattttgtaatttcaatataacatatacgtatatgtttgtcaatatgcagaaaagatatttataacttccgtcgggcaaaatccacaaacttaaacttgtcaggtctgtgtcgtgattccgtgtactggaataaggtggagtcctccagatacgtatagcttttcaccacgacaaccatatcatagcgccccatatccaggagtcggtaatcctcatccgtggccatatggaccgtgatctccttcatggcaaagccgattttaaggccctgttcattttccagatattcataaacagaatcctgagccgcccgcaaagggaggttttccacgatttttctagaaaaataatccttatcaatgatgattttttccccatcgatctcccggacacgctccagcacaaaggcttcatcctcaggtccgatctgcagcgcttccatcagctttttatcattctttacaatttctaaattctccacaaaggtccttggcctggaatctgaaaaacggtagatttccttaaagcttgcgatctccgacacagggaaattgaacttgctcttatccagcacctcagctgcctttccccttgctttgcgaatgcagccatcttcaactaaaagctccaaagccttgcggacagtatcacgggaagcgccgtaaatttccatcagctcaccttccgccggaagcttgtctcccggacggtattcccgcctttctattttttcaaaaagctctttataaagacgtctgtatttactctccatatgttcatatcctcactttacctgtcttttccattttccgcccatgctttttgggcagtgcctgccccgctctaccgggcatataggtatacccgcagggtgtttccactgatttagatatcagcttttattttaacatatacgtataccttagtcaaataaatcggttctatacacaaaaaaggcaatcctggatcatttttttacatacacctttttcttttttaacaaatacaatgaaacaataatctattttcttttctttccatatatggtttcatatggtaaactgtttttagagcaaagattacaaaggaggattatgcatgcaaatgcagtacacgaaaaatttaaataacaaaagcgtccttggcattatccggcgcttttgtaattacattgatccgcggcttacggaacacggttcccacgtggcttatattatctcccgaatgctgcgggataccgggcaatactcacagcaggaactccgggacatttgctttcttgcccagcttcacgatatcggggcgtataaaacagaagaaatttccaggatgcttcaatttgaaaccaatgacgtttgggaccattccttctacggctacctatttatacggtatttctctcccctcaaagaattggctcctgcagtcctcctgcaccacatcacctggaatttcctggataagggaaaagaacccagcgcaaaattaaaagatttatcgcagattcttcacattgctgaccgcattgatgtctccatgtcactggaaaaacgctcatgggcggaaaccctccgattattgatccagggaactaacaatgtctttgcacctcatatcgtagatcttgcagccaaacttgactttcaggaatccattgatattgaatggagaaaagattcagaatacttcgacttcttaaccagcattcctctttccgaagaagaaactacggaatatttgaagatgctggtctttatcattgatttcagaagtcaccatactgtgacccacaccataaccaccaccagcatcagctatgagctgggaaaactcctatccctggacgagcaccggctgaatttagtcctctgcggctctcttctccacgatttgggcaaaatcgccattcctgtggaaattcttgagtatccgggcaaattaagccaccaggccatgaacatcatgcggacccatgtaaatttcacagagaaaatattcggaggaagcattgacaaaacaatagagcgcatcgccctgcgccatcatgaaaagctaaacggatccggatatccgaaaaagctgaaagccgaggatttgactatggaagagcgcctggtagccatcgctgacatcatcagcgccttaaccggtaccagaagctataagtcatcctatcccacagaccgcattctgcccatcctgaccaggatgaagcatgaaggcctcctggatgcagccatcgttgacctggccatggaacatcttgatgagatccttgataccactgccatccgctgccagcccatattaagcgtttatgaaaagctgaaaacagaatatgaatcccttccacagctgaaagcctatgatgaaaagctttgtttcgctcttgccttaaaggatccggagcttatgccgtcatggccatgatgtgaaaagatccatctggttttaaatggattcagactacggacaaagccttgagatagaaaaaaatagcttcaagcataatctacaagcttgaagctatttttatccttccaccagaccgggacctatataaaacctggttttcttcctccccttcagccttttactgtaatccggaacgttttctccagaggcgtgtacccattggcatagaccgtataccctggctgtttccctcttcacctgaatagtgcccctggaattcatgctcaccaaaacccggtcccagtaccagctcttttcgttcatcccgaactgtcaaaaagccctctcttaaaatcaggctttcgcccattcctgccttcaggctaaaggacggatgctgtaagacagttcctgctggaatacagatctccagccgcatgggaagacggtccagcccctccgtcttaatggaaagctccagccctgttccagctcatggatttccaccgtagttttcagctggctgcttatgagcttttctctttttaaatgatccattttccaccagtcagaggtatcctgcttctctttaaagggcagataataccagccatctgccacggcttccaccttgcatccgttctcctgctcctctattttctgaggaatgaaattgcgaatgtcgcaatagctttctccgatctttacataaaccatggtgccttcgcatttcaaatacaaaaatgcactctttccgttaagtaccgtataggtgtaggcctttttctttacgcgaagcactcctgcatggcggaaaaatttccggtactcctctaaaaagccgtattcctgaaagcaatgatcaagcattttatcatggttcatgactacatgcagacaatccggtgccaaatctccccgttccatattgtcacggatgatcttatgggcagctccgtcaaatatggaattttctgcataactgcacagaaacaggtactggtaaaaatatttgtccccatattcaagctttcccttgtcctgtctggtggagttctgagtaaatatggtatcgtcgggatctatataagtcagcatcatggcaagattccgctctacatagcctaagaagctctcatctttgctctcttcatacatggctatcattgcgctgttcactaccgcattataattgccggtggagcgttccgcatattcaccgtcctcatccccgtcaatgccctcagacagatactgcccggcccgggccataagctgtccggagaactccttctcttctgcaaacagattggctccctgaagcaaggcagcagctatggcccagcggtgattcggcgtatgaaagcctcctgtgaggatagcctccagtgcacggtgcatgattattaaatatttttcccgaaggatcaaaagcctctcatccttctccacatcatactttaccagcagccggtaggcagcgatcagccgcttaaagcagaaagcagtatccgcagcggacttgaagttacaggacggataatcaaagcttccgtcctctctctgagtcctggccgcaaaatccagtgccaggctgatggtatcataaagagccttttggcggtaaaaactgctttccctgtttaaatatacagccactgccgtagtcagcgcataaatcgtcggcttcgcctcccagatatctccccggattcctccgtactttaaatctcccggatcttttacctgtccgtccataaactgtcttgtcctatattctgcccccttcagcagatgtatgatataacgcttcatattcttcctccgttttttggccctttgtaccagtgtaagcaagttccccgcaaaaattcttccgcctcttgacagccccatcttatcatttatatctttctgtttctacctcatttttgcctttatacaggcaatatcattacacattttgctttaccagtcattccaccagcaaatccccaccacagcttaatgcttttcgcatttgaaacaggaaacttacttcattcggttaaagtgacctttaattacagcaagctgccggttcacccgctcaggaatggatctcttcagctcctcccaggtcatcagcctgtcatccggcagagaaaatggctcaaattctatggctggccggaagccaaatgtctcttttatatatatttccgtcattttctgtaagctctcttccacatgaatctgatctttaaacatgtccggtaccagaacaccgtcactcccggctttttccagacagctttccagccatccagggatcacacggatcattctgggatcaggaaccattccatgctttccgggctgggcataaaccactggatgagtatccccgcaaagtaccggatccccgctttctaaatcaaccatatttaaatatctgccgtgaaagcttgcctccacttttttcacagtgccgccatggcttatgtaaacccatacatgctccagttcatatagatgctggatgtcatagtcataccagattgcgtactctatggcataatcaatctcttccttattaatatcaatctcccgtttaggaaaggaactgcttttctttgtctcacgaaatatcgtgcagcccattgcagtaatggaaaaaggctcgttctgatccatcataataatcggtttataagccttccatatgtccagatccttattcatattatttatcctttcttttttactgccattgctgatcttttaacaaatgaaaagagccgattgccgccaaatccatccgcccttttcatttcagttattttgatgcttccaacagaaacagcattgccattgcctgtccatatggcattgggcgtaattcaatgtctttataaaactgtacgctttctcttcccatgggcgttccgtaagatacctgatgcaccacaccttcttcatcaatgcactggagaacaggtaaaagagcctttctggcacttgcttcataagatggatcaactagtcccaaatgaactgcttttaatattccataaccaaacccgcaggttgcacttgcctccacgtatgaggtactgtcatcgattatcgtatgccacataccgctttcattctgataagaaaccaatacctcaatttgttttttcagcgcctctgtcagataatgttttacagcattgctgcatggaatgatgccgaataattccggaattcccatagtgatccagctgtttcctcttccccaaaatgcgcctgagaaattatggcggccatgaaaggtccagccatgataccagagaccggtttttctgtcagccagatattttgcatgaaggagaaactggtattccgcttcatcggtccattttttattatccagcagaactcccatgcgggccaggaataaaacggccataaacaatgtatcatcccacaattcctgctggtttaaagtatcggaggtaagatgttggaatccgccctcttctgtccttggaagctcttctaccagccattgcgcccagtccctgcagatcttcatgtaggttttattgccatttttttctgccagataggacaaagccagaagtggagctgttgtattaatattgcgtgaaggcaaaccaatggtcagctgtctttcataatacttttccagtttctttaaaaactctttttctccggtttcttcatatattttccataaaccgtacagtcctactccctgggtccattcccagtaccggtaccgctctgcattgtctccggacagattatttttttccatattttttaaaaagatatcatcttcatcatacagaatttcttcaaagcttgaaaccagcaaatcaattttttcttttattttctccattcctttgccacttcctttctgcttccagccactttatcggttggtatactttgcaatctctgcaatatttttcctttttttcagataatgtattgcacattttgtgaccgctctgttataatacatatccgaaacatgattatcccataaatagaataaaggcggtacccatgacaaatccagatgatacactgctttataagaaaaaacataatattaccataaacgatatccagcaatcactttattattattttgactatgacgaacgttcctttgatatcaacatgccattccagcattttcattcattttatgaaattatgatattaatcagtccccaggcctgccatctggtagagggcattccttactccatccgtaccggggacttagttcttctgcgcccatcagttctgcaccggacggaatatcagaaaggggctcccagcaaacggcttgtcatcggctttttataccctccggaactctggggaatgccggaaacttatgaaaagattttcgaaccattttattcccctcttcccatataccgtttcccctccaaacagcagcagctgatcaacgaaaaactgaaccggatttaccgctactccttccaggatgaggaaccggaattaaaatccctgattattcacggaatgtttgtggagtttctttatacaataagacagctggcaccttctaccatctacaccaatgaaccattaaaggatgaagcatccaaaaagatatacaccattgccaattacattcataatcattattcgaatgaattgactctggactccctttccagggaattttatatcagtccttattatctgtcccatcagtttaaagatgtaacaggctacactctcacccaatacattcagatgacacggatccgaaacgtacaatacctgcttataaacaccaaaaagaagatttctgaactggcggaagaatgcggctttaccagcttctctcaatttaaccgcatatttcagaaatattgcagccagtctccatctgaattccggaaagacggaggccagaacagccttccaaccattttttaaaagaccaaatgggcagaaaaagcccgttacagcttcccggcatcatcattatttcgatgaaaaagagctgtaacgagcttctaatagcctgctgccctgtaaaaggaattactttatgctgtcataatattctgctcttgcgtcaagaattttctgcagccctgcatttacaaggttgttgtattctgtctgctgcatgctgtcaaactgatccggtgagcagcttaccagcttgtaaacatattcaatcatcatgtttaccacattctgtccataatctgcctctgcctgtgaaatattagagtatacagggaagcggaatttgccttcagaacgcacatcatagaagttggagaaccactccggagtttcccagtctacggactgatcgtttatccatttggatacgatagcctctttgctcttggtccattccatagaaaggtttacaatatttaagtcatcacaggttcccggatatcctttgccggacagttcttcgctggataatttgatgggtattccattttcgtctctcttatgctctgctgtgtaaacaatattctcagcaacctccggatctgcctgccaatttagatacttcatacaagcatctacttttttctcgcttgacttcggaaccattacgaacataccgtatctatattcaaaaggtgtgcggtaggaaccgtcagccagttcaaagcactgtaccggaacaaaggttcttccgcctgtgctctggtttaagatggtaatgtaatcccatggacgctctgtgtcatctaaaaagaatcctgcatttcccgctgttacggaagacttataaatatcctccgttgtatcggtagcaaaatcttttgtaatgagtcccttgttgtaaagttcgtttaatttcctgatcccatcaacggcacctggagcaactgccatataaccctcactgtaaacataagcatccttgtcgctttcaaggtttacataagatcccacaaaatttaaataacccttttctgtatcattgcgtccgctcattgcccacggaattacctgattaactccgcctggattcttatcttttaccgcctgtaagtactcagtcaattcctcttttgtctttggtatttccattcccagttcatccagccagtcctgtcggatatacgcagtatgacgaggagattccacgcctctttgcttcatgattgcaaactgttttccatcaagctgtcccatgttctgtgcatcggatacaaattttttaatatcagatccataggcttcatacgcctgtgtcaaatcagccaggccgccattttgtgcaaagttataaaaaatgctctgactgtatgtaaacacaatatcaggagcgcttccgccggacatcatgatgttcagcttatcatcagaagaggatcttggaacggaaacgtattccacattgatattgtacatttccttcatctgctgtttgatccattccgtctgggtgttgttttctaccgttgttccaggagccgcatcacctctgtcccaaaccataaccttaatagttacttcctctcctttatctgcggcagctcctgcctcagtttttgtttctgcagcgcctgctgctttcgttgtttcctttcctgcaccggaactgcatccggttaccagggctgctgctgcaaaaactgccatacagcttttcaataatcttacttttttcatgaaaaacctccctttcttttcttcctatatttattttaaaaataaataatcatccttttaccgcaccaagcataattccctttgtaaaatacttttgtataaacggataggcaataatcattggtgtcatggaaatcgcaatgctggccgatttaatgttatcagcaaccagctgtgatgtaattccctcttcctgggatattttaactgattcgatcagctgttttaataccatttgaaccgtatacagcttagaagtgtttacatagtaaagaacatcacttaaccggttccatctgcctactgcataaaacagggcaagtgtggccaatgtggggtaaaccaaaggaatggccactctgaacaaggtctgaatttcattgcagccatcaatctttgccgcttcataaagcgaggagtccactcctttaaaagcagtgcacataatgatcatattatacgcgctgagtgcctccggaataagcagagcccacacggtatcaatcatcttaaaatccttgacatttaaatatttggggataattcccggatccagatacatggtcacaacaaacagggtcataatgattgttccgccctttaaattcttttttgaaagcgggtatgccgccataattgtcatgataatgcatattgccgtagatcccagcatgaggaaaacggaatagataaaagaagatgcaaagcttccgcttcggaatgccctgacgtaagcttccgttgtaaactgtaccggatacagaaaaacctttccgcccagaatcgcatccttggagctgagggacatggatataacacggatgatggggatcagtgcgataatgctgactgccacaaaaaaagtattccagaaaagctgaaacctgcattctgtcttgctctttaattctcccattacataattccctcctctcccatttttttggaaactttattaaccgaaagaatcaggataattcccaccactgactggaacaaaccaactgctgtggcaaaatcaaatcgtcctgcctgaaggccaacgttataaacgtaggtactgataacatctgaagcactttttaccagagtatttcccatcatataagggcggtcgaaatcaattgatacgatttttccaagctgcatgatgagcataatggaaatcgttggcctgatctggggtatggtaacatgagcgattctctgaagccttgttgcaccgtcaatatacgctgcttctcccaaagacggatccgtggctgtcagggctgccagataaatgatcagggagtagccagctgactgccagacacctgaaaaccagtacacaaagcgccagataaagggagagcttaagaagttcacctctgtaaatcctgctttccggatcagatcattgacaagaccactggctgaaaacagctgcgtaataataccggcaataatgacccaggaaagaaaatgaggaagatacaaaattgtctgagttgcttttctgatatgtatgtttcttatttcaaacaggaaaaccgcaataaataccggaatgggaaatccgataatcaaatcacctgcatttaaaatcagcgtatttttcaatgcattccagaaatcctttgatccaaaggcttccttaaagtttgcaagtccaacccatggactgttccagatgccggcaaatacattaaatttcttaaaagcaattactcctccgatcattggcttataacggaacaggagcatataaatcaccggaatcagaagcatgaaataaagctgccaggtattgcggaaatacaccttaaacgggatcttacgcagcctttcctttgttgtttttcctttcatcatatccataccctccttctatacatttccgtcttttgtaagctctgcctccagtctttctgccagagccagaagctctttcggttcatggacggtatagtccggcctttcccattcatcagccggagtcatatcatagcgtggagaccagtcaatgagaatggaagtaattccaaaacggttggctcctgcaatatcctttttcacattgttaccgatcataaccaccctttttttgtcttcttctgtaagatggttcttctccatggcatcctgaaacatcagcctggaaggtttctggaaccctactatctgagaaattgttctggtgtggaaacaataaccaagaccgttttcttcataaacattggtgaaggactgttcttctccatccgccaccatggcaatgatataaccggaatcgtaaagagcttttaaggtctcctctgcaccgggtatcaactccgcgtggattacaataccgttttcatcgcgtatttcggtttcttcgtcaatgattgtatctccgctgtctgtaaaaatgattaacttttttgtcattttgttaactccatatcaagttttggcgttttcatcttaaagctgatgaaatcattataatattttggttacattgttgctatgcgtaatttgttattattgaaatcatcttattcgcattttttgcgtttatggaaccagccgaagggtcttaatctcaaaaggcgcaaaatgtaagagcatttcactgctattttcaagcaagttcaccggaacagactcacttcccttcaactcctcctccatggcagtttcccacacgctgctgattttaaaaccggctgccgcccggcaggaggtatgttttccaatggcttcatagaatcttaaaatcatatgattttcgccgtcttctgccatcttcacagtctccagaatcacattttcttctgatatccggaaaaattctttttctccgataccctttccccaaaatgccaggggcagtttaactgcattccttcccgcacaactccgctttctgtaaagttcctgctttctatatagaaagaatacgtaaattcctgtattcctttatccgcattcatatccggccatacaggagcttttaacagtgtcagttccatggaatttccattggtgctgattccatatttggaatcattaagcactgccgctgtccttcccggttccgtcattgcagtataccggtgattacagacctcatagcggtctgcatcgtaacgtcggttctgatgggtcgggcgtttgatatacccaaactggatttcttcaaaggcttcttccgtccggatcgtaaccgggaaagcagtcttcagcagtttatgcgtttcctgccagtcaatggccgtaacaaaatcaatccgcctgctgttataggataatgtgattctctgaatcagagaggactggtgaatcatcctctttaccagaagcaccactttaagcggtcctgtctcctctatggcgagctccgccctgtttcccggctctgccggcacatttttatagaaggaactcatttcccaggcatcataatccacattaatatcctggtataagaaaaaccggtttgctatcccatccacatattcgatttttgtttcctgatccaaggcactccttacctgaccaagatcgtcaactattatcttgaccaatccgttttccagcacaaaccaaccgtcttgctcatagatccggcataccttttcttctgaaattccggtataaacagcttgatcccgcccaacaagatcggtatatccgcaggagggaaccttcacaggaatcagcagcctgtctccgattttctgggtcacagggaaccttccgctccggaccagacgttcttcctctctggccggaatctccgccagttcctcccgctcccaggataaagaattgaataataggataccgtcagcctctgatcctgtaatctgctttcttgcttcttcataaaagccaagcgctttttctccggtggattttaacgcttccctggtatcctcatataccctggcaatggaggttccgggaatgatgtcgtgaaactggtgaaaaagcagcactttccataaggattccagctcttccctccggttttctccgttttctgtgaagcatgcaatggaatttaaaagttctgcttcccggagcctccgttccgtcagccggttttctttcttgatccacgcctgggaggtgtaggttcccctatgccagggcagataaagttcccctctgtaaacctctgttacagagccttcctcttccagccgttgaaaaaatctcacaggaccttccatactggtacggggtgccccttccaaatcctttacacgccgtgctgtttccgccatctctctggtggcaccgcccccgccgtctccgaatccgaaaggatagagaaaggaatcaatattctcctgctggacccggtcctcctgccatcttgtgatcaaatcaaggggatccagccgggcgttattctctttataaaaatgagtgagaatcctggtaccgtcaataccttcccaccagaaattgttataaggaaataaatcgcagccctttaatgccctggaaaccttctgagtagcaaagtaacggattccgcagcctttcatgatctgaggcagctgtccgttaaacccaaagcaatcaggaagccaaaccaaaacactttcttttcccagctcttccaaaaaccactttcttccgtaaaggcactgacggatcagactctctccggataccagattggtatccgattccacatacatcccgccttccggtataaaagctccgtcctcaaccttctgaagaaggcgtccgtacaactccggatagttttctttcacattttccataatgggaggttcacataacaggaatttgtaatcttcatattcatcggacaaggcaatctgtgtagacagggttctggcacatttgcgctttgtttcctcccagggccagagccaggccagatccagatgagactgtccaaatatggtaaactccggtgcggttgacccattgacacaggaaagcagcggtgccagtctttttcttgccttacgaaaggattcatcccgtgcctcccggtccagctcaaaatctgccagaaaagtaaattccaaaagtccctgatttactttcatagctcttaaagacttgggatcaagtccttgggaaagcttgtaaagggtaactgcatccatgagaagctgaaatgcgtcttcattccagataccgaaatccgaagtgcctgtcttcacctgaaaggctggaggttcgggaacagctgtgcgccagggagggcatggcccgcctttttccagccttggaccgtgccctgcatagctttctgctaccacaaaaaaacgctcacctgcttttgcgcagcgggtcagtgtaattccgtcgtgctttaaatcttttgaacctgccgttactccattcacccagaccagcatttccccacccacctcagggtgtaggaaaatccgctttccctccgcctctctgggcatgacgatttctgtctgaaaccagccgtattcccatttacctccccaggaagtcccttggggcatgggataaaactcctgctttattgcttcttcataagtaaaatgctgttttgtcgtaaagccggtaaaagccacctcatcaagcatgtcaaacaaatggtttttcaattcctcgatccatatatttatccgtttgtcccgttctgctgcaagcatcatctgcatatccctccctttttcagtaaaatcatcatatttcctcattatacgatatctcatgggctggtgactatgcaatgtttgttaagttgtcgcagaattttcgcagttgttgttaaatttcagcatgaagaaaggtacagccattgatgcggtgtcaagcgaatattcgcaatccgcttcgctacttgctcacagtgtccccgatagtgcgggggagaccctgccccgctccatcgggcataaccgaatagcagcaagtcccctcacccaccgcttaatgcttttcgcatttgaagtgggggactttcttgattcggttaaaaaagcgtaaaaaatcataaaacaggccgtacttatgacagcacaaaaaatcagccggtcgatcatttcagatcttccagctgatttttattaaaaaccgcctctcatgttcccaaaaacagctcatttaccgcaattgccagaggaccgatatatccaattctgtcgctcagttccgacttcaggatataacttccattatacaggggatcgtagtaggtacagaagttcaggaaacgtttctggatattatccatttcaaacatgaatccatagataatgaccttatccggtgccagtaaagtgatggtattcaccacggtacgtgccagacgctccacaatgtcgtcaatgatcttctggagtcccggatcatctacttcaatccactgttccatgttccttacctctatcctgtccacatcaccctccacaaatgcatacagcccgggcatggtctctctggtgcaggcccgccttacccggtcagcaatggcatgggtggcgacatgggtttctaagcagccccgtctgccgcagcggcagggcagacctcccggttccacaatgtaatggccgatctccgctgtcttggagttctggctgtcgtaaatcttgttctgtatgataatggcagatcctacgcctggcccccatttaataaacagaaggttctcctgctttttacctgtgccgtatatgagttccccttctgcaaaagcctttacattattatccaccaccacaggaaggtttaaatacattttcatatattcccccaccggcactgcctcgttccatatgcggtacgcatggagactcacccctgtatcccttttcacaggtccgggaattgataagcctgcacctaagacagcatccctggataccccctgctcccacataaaatgcttgctttcgtcagcgatcttctttaaaaatgcctgaggctccagagaagtctctgtcttaatctttttcaatcccttaagacacccctttaaatcgctgatggcgatgcaggtttccggtgcctcaatgctgacagaaagcacatatttgtaccggtaattgatatcaatcgatacctttttcctgcctgcgcgcttctcctcagccatctcacccttttccagcagaattccggcggcaattaagtctgtgcagatcaaggtaacggtagccggagtcaggcccagctccatggcaatatccttccttgacatggctccgtggtcattaaggagttttaatatggcgctgcggttgctcactttaacattttccagattaattcccgtatagcccatatctttttcctccgtttctcaacatatcatatcctctcaccagtataggcgtaaacactgttaaaatcaagaagaacctttgatatcccccctgcaccccacactaataaatacatgcctccatgcccagcatatgagccagcatagtaagctcttccgccacgtctccgtagatcacaacaaaatggggttcccatccggattttacgctttttacaataatatcctttgcatcatgatccgtcttaaccactaccgaggtcccgcaaaactgcttcggacggtccagagcttcccctgacgcaatgaaaaagcggaagcttccatcagccctgcggcctacccggaaaacagtaaccttatcccaggcctggcagccaaagtccataaccggcccgatcttgcggttggggtgtacacccacttctgcaccggtatcctttcttgccagggtgcagggtgccatgccgcaatgccagaaggtgatggtaccttccttttcatccatggaaacagggtctccgaaaaatgcggcattgcctgtcagctgcattcctatatacatggacaaagccccgtatacatcagactcgcagctggccgccgtccccaatgcattgaggagggacagcacagaacatacaggagttccgaatgctgtaaaaaagtccggccagcaccgtgaagacagggctccgatccggttctcctccacatacatcctgtaagccttataaagccttgcaaagtccttcacattcttctccggcgtctcgtctaagctccccatcatggcttttgcctcctccagataggaagcgcactcctcgtctgtataggatttggccttatcaatcagctccctggcttcgatggagtccaatgtcacaccgaatccatgcatcagttctgcatccaatgcccttccaaatccaaaaccctggggagtatgaccgatggaggccatctttagatcccttaactgatgctttaccctggctgccctgatggcagcgcctacgccggcagccaccgcctcctcctccggtgagccgaaaatatattcaaactcaccgtcacggaaagcgcggagcgcattacccgcagaatatgctccggtaagggaattaagccttaagcggcctccgtcgatcaccggctccctcagtgtccacaaaagcaccggacaggtgaagcgcttaaggatttcgcttgcataggcagcattggcaaaggtgatgttctggaggatgataagacccggatttatggtatccaaataggaatttaagtcatttatggataaaagcatgttttccggatacacggcctcctctgtcagagaagaaatcagacggatggatttctcaaattcaatctgcgcactttccaaatgaaaggtaggtacaccgattggtatgtatgcaacttcaaatttcatatttttttatctcctttgaaatcaatgcaatattcttcccatattatcccgtaacctattttcccagaagggaaataccagagataaacagaagcacataggtaatcatcataaaaagcctctgactcattttggcataaagtctgcctcccatgaacatgccggccagcaggaaggggagggacatgaccagcgtcctgactaaatccggactccacagacccatgcgtatatcatccagcagaacgatggtatttaacaccagccagacagtggaaatagtggcccggaagctcaccttgtctttcagccttttggtcatatatcctatgagaagcgggcctcctgatacgaaaatgccatgtacaaggcctgcaaggcccagcagcaggtacatggccgtggaggtctttgtatcctgggcactccctggatttccggcttcttcccctttttatccgttggtccgtttgcttcgtgccgcagctttacaagcccctgcccggaaagaaggatgacaaataccccagcatccggtatagctgctgctcctgtccttcaaagaacccctttaaacaaattcctcccagtatgccggctgccatcactgccacgatttttttaagctcgctccaacacacgcttttcctgtgtcctgcaaacacatagaagcctgacagcaatcccagcacgttgagcaccggtttggctgtgttgtaacccaccagcatcaggctgggaggcattgcaaggatggtcccggcaaagcctgtgattccctggatgatattggacagcaatatgatgagaaaaaatcctgcgtatctcatagattaccgtccgctttcccgcttcccatgggttctgcggatctcttcaaacaaaggggcgtattctgaggactttaagtaaaatgccggggtatctccaaccggtgcagccacctttgcctccccgcccctgtattcttcacctgtccacaggtgaatccattctccttcaggcagatagacatcccaggtatcctgtccttccaaatacacaggagccaccagaagatccgggcccagcaggtattcgtactggacttcgtaagctcttttatcctcctcatagtggaggaacagaggcctttgaaccgggattcccttttccgcattttcctttaccagctctttcatgtagggcgccagcatggtgtaaacctccaccagccttgccagctgttccatacagtcctcatcctcatagtactggaaattagtgtctggccggttcccctcatgggtgcgcatcactggagtgaatacggccatctcagcccatcttaaaaacagctccttggttcttttgttgtcaaacagggaggtgtatccgccgatatcactgtgacttaagccgcagccggtcataccggcgcttaaggccgcacagataaccgttgcaaggccgtcatgaatggtaaagtccacggactggtctcctgcccacaacagggtgcagtacttctggcttccggttcctccagccctcataaagtagaccacctctcccagttttccgctttcctttaccgcttcatagttgcactttgcccagagagcgggccagcggttatgttctttcatgggggatattccgctgtatagcctgatgtcatccgttgggagatattctccaaagtcagccatccagccgtcaattccaatatccaggctgtgttttttgatcacttcatttttgtaccattcataggcatccggattggtcaaatccaccactccgcagtaaaactcaccgaaatctaccagataatcccctccatccccttttgtggcaaaataccccctggcctttccttccttatataattccccgtcgtttaccagataaggattgatatagccaaggaattttattcccctgctgtgaagctcctgtatacgctttggcaggtccggatacatttcctgatgatatttccaatcccactgaaggcgttttccaaaggatgtgaccctttttccgcaccagtcctggcaccacaggccggataccttgattcctttgtccagagtcttctcaaggattcccaaggaacggtcatttcccccctgtacgcctatgatcaggccattgtacacccactccggaagctctggctgccggcccaaaaaggctgtcagtttctctaaaagctccaggaagccgggggctgcctcaatgcgtatggaagccggaacctcccatatctgaagctcatggaaatccctgttcctgaagtcaaaatcagcataagcagtggaatccacatgaaggtaatagtgcctggcggacacataggtgggctgtgggtagttggtattgtaataatcccctcccgccttattttccacatccgagcgccatgtcacataggtggtcttatcccttcccactcccggctcagaggtccataagggaaaatgccttcctctcaaattaaaataagacatctgctctccgcagccatagcaggattctttctcgtctgcctccactctgaaccagaaccggttaatggccggattgatctgccggaaggaaaggaccgcaagctctccttcaaccttaaccgtaagcacgatctggccctccaagtccatggaaatgccctccggctcctccgttattccggtaacccttaagggacgccgttccaccacatagtcctctatcctgtaattgcctctgtacatatccacggattcttctccgtatcccacatagatcattggcttgccgcttttacagctgagtatcctgcggccgtctgcatttagctcccagtccattcctttacgaacaaattccatatgtaacctccgtttgaaatccatcagaacatcatgatcacaaaaatcatcccttctgcatgccctctttcttcatttcctccatttgagcctgattcagagcctccaccttcttattgatccggagcatggaaatcacaagaattaccgttaatatcagaatcacacaggaaatcggacgcttgaagaaaatcagatagtctttatcatagctcatcatactggttacaaagttcatctccataatgtcggcaagaatcatcccaagcatcagaggagtagatgaaatatccagcaatgtgagaaaatagctgaaaataaggatagctgccgttaaaaccagctcttttacgtttcccgtagctgcaaatgctccggcaaaacaaaagatgatgatgacaggcgccaggtaggtataacgcacctgcacgatttttgccactgcacgggtcagcaccatgccgatgggatagagaaaaatatttgccaccagacagcctatgataatggaataagcgataacgccctgcttggtaaacatggtgggacccggctgaattccatgaagaataaacgctccaagcagcagcgccgtcacgccgtctccgggaatccccagggtcagcaggggaatcatggcagaaccaaccacagcattgttgctcgcctcggctgctgcaattccttccaggctcccttttccaaaatcctggggacgcttggaggcccgtcggcactcgttataacacataaactgtgccacaccgcctcccactcccggcattgcgcctaaaaaggaggctacgcaggaagaacgaaggcaggccggaataattgatttagcttctttcagtgttaaaccaaccttgtcaatcttcgtgatatcatccagattcccttctgccagaacaaaatcccgcagcttctggaccacctgggtcaatgcaatcagcgcgatcatggcaggcagcatatcaatgccataccttaaagagtctatgccaaaggtaaagcgcatcacacctgtcaccgcatcagctccaatggcagccattaagatgccaagcagaccggatataattccttttgccaggctttcgccgcttacgcctgcaatcagcgaaatgcccaggattgccatggaaaagtattctgccgatgcaaattttgacaccagttttgttatgagggaagcgcacaccatgaggagcagagcggaaaaaagaccgccgaaggtagatgcaaacaaagaggtgtccagggctttttttaccttccctttctttgccagggggtatccgtcaaatgttgttgcaatcgccgagttcgttcccggcgtattaagggtgatcgcactgattgatcctccatacataccgcctacataaacagccagaagggaaatgatggccgtgtccggcgaagaaaagctgtaggtgaggggaagaagtaaaatgatgccaagggttacgctaagtcccggaatacatcctacaatcattcccagaatcagtccgccaagaatgaccgctaaattaccaatcgtaaaaacctgctgcagtgcaagcagaatctgctgaatatctcccataactcaacctccaaatcccggaaaaccaggcaatgaaacgtggaatacatacttgaacaggtaaaagataccgattcctgctgccacagtgaatatgtaaataaatggcttcctctcaccgcagtaaaataacatcacaggaaacacgatgactacggcaagaataaatcccgctttgattgtcaggaaagtaaagaaacacagcaataaaatcatgaaaatacagggcttctcttttttccagtcaaattctatcactctatcttttttaaatattaagctttgtatcagcagtacagcggagcagatcaaaactcctgtaagacagatacccgggatgatccgcggacttggcgcacctgagtcgtacatgggaaggcgcacttcagacggcatgactaccagcattgcgatactaaacagtcccatgataagcccggaccaaaaataagtcttaatcttaaatttcactgaatcacacatcctttctccaattgctgaagaaaatggcaaggagggcattccggcaaaagccctcccggccgatcttccagccgtctcctactgctgcccgctcaaggtgtcaaatgcagcaaccgccttggcacaagcttcttccagatgtacttttgcatcttctccatacacttcaaacttattcagcttaatctcactgatccagtcactgtattcaggatccgcccatacatctttggaaatctgtgcaacctgatcgatccatgcctgatccgcaccggtacgtactgcaataaatccgcctgccgccaaaatggaacctgtataatctgcggatccattcagttcgggagccttggtttcaccggcaattcccggaacagtgatttccccatcaggactcttgaagccttcaaaagcctgatcagagaatgcaaggatcggagtcattgtccctgcctctacatcctctaaggcgacctgagtagtgccaacaaacacatccacttccccgtcagtcagccccttcttctgggcagcgcctccgtcatagggaaccaccatcactttaccgccttccaaagctaccagggagcctaatgccagatggggatcagaaaggggattcccgccagacatcttgatgccgccattcctggatttctccaggatatccgccagggtcgtgcctggttttccgtacataatccaagtcctgtcatcaatggatgcaaccggatatatgtcactgcggtcaaagtccacaacctcagtctgatatttcttgccaagatcatgacggtatgccacaccataaccataaaccagcagttcctttgtggacggatccaaatcagtgtaatagtttgccgcagaaaaaccgtctccgcctgtcatattttccacgataaaattgtattccggatgaaccttaccggcaaccagcgcatactttcgcgcaatggaatcagcagtgccgcctacgccgtaaggacatataattttgatggttgcaccgctttggcctcccgcggctgcggttgactccttcgaggtatttccggatggttccgattgtgtggcggacgcaccgcatcctgccagggaaactgctgtaacagctgcaagtaccattgctaatattctctttttcatatacaacctcctgatatattatttgtttttgcttttcaattcccttaatacttaagttccttattttcccctataagtcccggaacagcgccctgcctgatcaagggttcccgttccggatgggcaatgacccatttgttgcgctgcaaaagcagttttccttcgtcctccgctgcctccggcttatgctccaaaggcgtattcgttccccttggaaggattataatatctttaaacccttcatccgttacccggcagggtgacaagtggagcgtggtctggtacatctcaacaactgtccctttttccacaaaaaacacctttgcatcctctgtcttgtatgtattatccttaatctcccatacatggcctaaaaccaccatgaaatccgtcacggcgatattgatctcactgcctttgtgatattcaaatccattgtaagcggtatttcttccattacagtaccctacctgtatgtccatcccgccgtaaaacccatctcttaaaaaagctgccccaggcacctgttccatctcaggaacagaagccaggtatatgttgccgttttccggtataagagatttttcttccatgtaagacaccatgtccgagaaatcatatcctgtgaccacccgtccatatgttttaaattcctcatcaaaaacagagcggactgccacatcgttgacttcgtttaaccgtttaatcatcatattcctcattatcatcttcctctgaatctgtgaccggacttttttaagcgctcctatctttttactatttttatagtagcgcaaaaatcctcatttccatatccggcttccatagccttttcataaaccccccatactgcctgctctccaggcattgaaaagccgcattcatctgccagcttcatgcagatacttacatcctttgccatgttttccactgagaaggcagtcgtataatcctctgcatcaagaaaggctttcttggaatccagataaaagttctggcccccgccataggagacggcttccccataatccataagggaaattccatttcttgccgctaaggcaatggtttcattgaccccattctgaatctgggataccagggcattgtggcagatcttcattaccagccccttgccgttttcccccatatgctttacattttctcccatgtaaaggaggatggggcgcattctctcataggtttcctcatcgccgcccacatagattcctaatttacctgcaacagccgcaggttttgactttaccaccggggcatcgatgaatccggctcctgtctttttcaccatctctgcaattttcactgatacgctgggatctatggtactcatgtcaatgcaggttttcgtggaatccagcacttccaggatccccgtgtacactgctttggagtgctctgacttggggaccattgaaataatcacatcagacacctttgccagttccacggaatccctgcacgccacagcacctttagccgccagtaagtccgccttttcctttacaaagtcaaacacatagactgtatcatcatgctttttcactatattctcacacatggactcgcccatgatgccaagtccgataaatccgatcttcatatcccagcctctccttctcgttcatttccttacgcccactattctgtaatggtgttatcccaggcattgataaaggtttcaatcccctggttggtataagcgtgtttcatggtatcccgatatacatccaggccggttgtcacaatgtcggctcctgccacggcacattccacaatctgcttgggagtacggatcgccgcacagataatctgtgtctttttgtaaaagccataattcttatagatatccacaatattttgtatgtaagccttacaatcctcaccgttggcctccttccatccgatgaatggggatacgaacagagaatgattcctggctggaagaatggcctgggcaggtgaaaacaccaatgttacattcgtgcggatgccttctgcctccagttttctggccgcagtcattcctgcctctgttgcgggaattttgattacaaaattagaactgattgcagcaatctttctggcttccgttatcatggcctctgcttcatccaggtgaggattgatttccactgatacaggaaaacggtcatacccatccagtccctgggattttatccaatctgcaatgccatggattgccgtaagaaatggttttccgctaagcatgatatgccttggattcgttgtcacaccatcaataccaaatgtgttgtaagcaaactgaatctcatcaagctttgcgctgtctaaaaaatacttcatagcctaagtcctcctcattatgtttattaattttattaattaattaaatcaattttactcaatgctctgtttttggtttttggtttttgtcttttatgtttaattttattgtttatattatagtaatataatccatatgtcaatggataatttggcggtttttatattttgtcatattgtttaaatcatttaatcaattttatgcagattgacggaatttttatgatctcccaagtttcagcacccggaaccccctctccccttctcataaccttattgaagcagaacggggcaagcatccggctgctgtaatatcaccgggactctaggttttaatctcattggtccgcacagaactcatggagcaattttcaaaaaaagaacaggatatgcatttttgcatgccctgttctatctctaaaaggtgtgaagttttagctgaatcgcatctatttttcagcatcttcttttttattgctttgcaatcacccttacaaactttttcttgcctctctttactatcatcccatctccggacaactgctcctttgtgaaaacagtctttgcatcagaaacagcctctccttccacgatcactcctccctgctccacattgcgccttgcctcagaacggctgggtgctaagccggatttttgaagaatggacaggatgtcaatgctttcgttaataaaatccgcctcatccagctcacaggttggcatatctgccgcattgcctccggtaaacagtgccctggcactctcttttgatctttgggcttcctcttccccgtgtaccagcttggtcagctcataggccaggatttcctttgcctcgttcagctggctgccttcccagccgtccatttcgtcgatctgctcaataggaaggaaggtgagcattcgcaggcattttagtacatccgcatcggcaatgtttctccagtactggaagaaatcaaagggagaagtcttttccggatcaagccacacggcaccggactgggtttttcccatcttgtttccttcggaatttaaaagcagggtaatggtcatggcatgggcatcctttcccagcttccggcggatcagctccgtgcccccaagcatattgctccactggtcatctcctccaaactgcatgttgcagccatagcggttaaacagctcataaaagtcatagctctgcatgatcatgtagttgaactccaggaaacttaatcccttttccatacgctgcttatagcattcagcggacagcatgcggttaacggaaaagtgcgggcctacctccctgagaaaatcaatataatttaactccagcagccagtcagcattgttgaccataagggcctttccttcggaaaagtcgataaaacggctcatctgctttttaaagcagtcacagttatgctggatcatatccacggtcatcatctgacgcatgtcgcttcttccggacggatctccaaccataccggttcctccgccgataagggcgataggcttattgcctgcctcctgaaggcgtttcattaaacacagggccataaaatgacctacatgaagactgtctgccgtgggatcaaatccaatataaaatacggcctttccttcgtttaccattttactgatctcttcttcgtttgtcacctgggcgatcaggccccgggcttttaattcttcataaatcgtcatcgtcattctcctttttcataaaaaaataaaccccgtcctatcaaaaggacgaggctgaagtctcgtgttaccaccttaagtttataaacagctcacgctgcctacctctttgagtacctgatgcgatactctagcacaataacgggtgcgggaatccgtcgcagcctacttggcatctcagccgttgggtacgaagctcaaagatgtattcacaatccgttttccacgcgcctctcatctgccggctgctttctgtgtggtccttcaaactgctacttgttcttatcaacgcttttacatttgtttatgaagttattgactagtatatgttggtttgattaatttgtcaagaggggtttttcgaatttactctttcatcaggcctgacattacgcacattcccgccgcacccctttcctttatctcctttaggcagctcacggtaagcagcatccctccaatggcataaacaggaatgctgacagcaccgcatacttcctccagaaaatcaagtcctctgggaggcacgccgggtttacagccggttttaaaaatatgcccggcaattacataagtggctcccagttcctctgctcttcgcgcctcctgtaccgaatgaacggaagtgcctatgacagaaaactccggttccgcccttccttgttcctgtaatttcaaaagaggcaaatgtatcttatccacatgcagtttcttcgccgtatcggaaaaagaatgaagaatacagggtacctgaaagttttcgcatattggaagtacaagacgggccagcctttggtattcttcctcctccatatccttttccctcaggaccaatgccctgggctgcagtctgcagacagattctatttgttctaaaaatggacggctgcataaatgccggttggtcactgctatgattccctgataaaattcgttcgatcccatacgttatacctcctgttatacatacagataatcactcatgaccggctgcataccaagccttagcaaatccttcatgaccgcgtccacggaacggccgtctgaaatctcaaactgactgtcccccttttgctccgtttcatccgcatgtccgccgattccggtactcacccctgcggaaatttttgtggctgcaatgtttaccaggttatcccgtacccgggcacattccctggtggacaccgtaatgcctgcaaagggcatgaacaggcggtatgccgttactacctgcaaaagctggggctcatgaacatccatgggattgattttattattgttgatgatcggacgcaggcggggacatgagaaggaaatttctgcatgaggatactttcgctgcagcagataggcatgcatgccggttgcgaaggcatctttccggaaatcatccagccccagaagggcggcgatccccactccccgcattcctcccttcagggccctctcctgggcagcaaagcggtaggggaaaatccgtttgtgcccggccaggtgcagagtctcatatttctcagtatggtaagtttcctgaaagaccgttacataatcggcaccgcaccggtgaagataggcatattcatccgaattcatgggatacacttccaaccctactgccttaaaatatttccgggcaattttacaggcttcccctatatatttcacatccgacattttcctgctttcccctgtcaggatcaggacttccttaagtccactttttgcaatggccctcatttccttctcaatgtcttcctcacccagcttggcacggctgatccggttattgcaatgaaaaccgcagtaaatgcagaaattttcacaataattggaaatataaaccggagtaaacagattcacactgttgccaaaatatcttctggtctcctttctcgccatacaggccatctcctccagaaacggcattgctgccggcgacagcagcgccgcaaaatcttccggggaccggttctcatgggccagggcacttttcacatccgcttcagtgtatttgtcgtaatcatagctttccatggcctttatcacccggtcctgtatgtctgaatgcaaaacctccatatccggcagataggtcatatggtcgatccggttttttttctgccattctttgatttcttcatttaaaatgctttcgttgttataagattccgtactcatgatttcctccttactcccgtaaaaatccggtcaggggcgacgaagggctggcgcccttttccatgacccggcccataccggccagataagcctttctgcctgcctcaacagcatttttaaaggcctctgccataagccgaatatccccggccgtggcgatccccgtattggccatgaccgcagcagctcccatttccatggcttcacatgcctgggagggttttccaatgcctgcatccacaataattggcagatcgatctcatcaatgagaatacggatgaactctttggtacataagcctttattggagccgatgggggcacctaacggcatgatggaagaagccccggcatttaccaaatcccttgccgcatttaaatccggatacatataaggcataacgataaatccctcctttgccaggatttccgttgcttttatggtttcctgattatccggaagcagatatttggaatcatggatcacttcaatttttataaaattcccgcttcctgcttcccttgccaaacgggcgatccgtacggcctcctctgcatttctcgcccctgatgtattgggaagaagggtgatgccttcgggtatgtaatccaggatattcgccgttccccctgcattggctctccggagagccagggtgatgatctctgctcccgccctttctatggccgactggattaaatccagggagtattttcccgatcccaggatgaacctggatgtaaattcaaaacccccgattaccagcttatcttcttttataggattcattttatttccctcctgtttttttataattccggctgaagaatcaattgggttatcatattggcctcatgggcagcacagattgccaccctgggagccatcagcccgtttccgtaccccggctctgacattccgtcgccgcaaagataaaaattccggcttatcttcctggtacggatctcattactgtccccgtatcctgccatccccgatgctgagaccagctttttatccgggaaatgctccattacgccgttcacaagcatggctttcatttccggcacatcaaacgcttcgcagatgatatcctctgattcaaataacccgggtaggttgtgctctgttacttttacacaatccgcagaaatctccagataaggatttattgccttaagctcttccttaagagcatccgtcttatacattccgatatgatggataaaatactgctgtcggttcagattactgatatccactctgtcaaaatcaatcaaatgcatatgtcccacaccgatacgggcaagggcaaaggctacattggagcccagtcctcccaggcctgctattgccactctggcctgattcaatttctcctgaacctccggggaatgacgcttttttagtgcttcctgaatttctggtttgcttaaaattccatgttccagtttcatgttaactcccttttattctaatctttctgaaagtccccgctgcattcctgtaatcagccgccgcctacaaagctgatgacttccaggatgtctccatcccttatagttgtttccgaaagtctggacctggaaaccatacggccgttatgctctaccgcaacccggtctgcctgatagcccataagctccagcaactctgaaaccaggatctcttctgacagcccctgctcctttccgttaaccataaccatgtcttattcctcctctcttgtatggcaggattttttcaaaaaaaaagttcacaaagaaatacacccgcggtggtgtaccccttcgtgaactttcattcactcacaataaaaatcctatccgattgtacgtcaaataaaaaagcggaaaatgcccgcagcaccttccgcaataattccttaagcgtccgtccctacgttggcattatccaaatcaggtatatgagtcgaagttcataacttcctctcagcctattacataagctcctcttttgacgtatatagtataaaacagaaaatccgggatgtcaacagaatttccggtatatccgttttttcgccttttttatttctggcggtaaggaaatccctggaaagttttaaaaggcagcaagctaaataaacattaaggcagtctgttatcctttattaaggtttcttctttattattgttttaataaaagaaaaaggaggcagattatgattgaagaaatattaaagtacaatgatacttttgtgagcaccaatggttatagatcctttgtcacagacaagtatcccagaaaaaggcttgccatattaacctgcatggataccaggctggtggagctgctgcccgccgcacttggtattcacaacggagatgtaaagctgataaaaaatgcaggcggcgtgattttagatccttttgacagcacaatccgcagccttctcatcgcaattctggaattcggtgtggaagaaatcatggttatcggccatactgactgcggagcagctgtcatatcctccaaaatcatcatcacacacctgcttaaccggggtattgcctggaataccatacaaaaactgaaagaggatggggtggactttgactcctggttccagggcttagaaaacacggaacgctccgttcaaaaatctgtttccttacttaaaacccatcccctcatgccatccaatgtaattatccagggttttgtcatggatattacctgcggcaaactggccgcagtttcttaatccagacggaaaaggcgccggaatttaattccagcgccttttccatttggattttattatcagaattctatgaaagggtcagtacaccaagtaaaagaccggccgtcaggcaaacaaagctcactccccatatccacaggaagcaggtcttaatatggtctttgatctccacacccgccaggcctatccctaagaatgtggcaggtacaacaggacttataaaggtggcgcagttgcggcataccaccatggcaattgctatatgcacaggatctacgccaaagctgtttcccacactgatcaggaccggaagaaggccatagaaataggaatccgtacagaacatcaaagtcagaggtacggacagcactccgatgatcagcggtaagaaacggcccatggactggggtataaatgcagcaagtacactggccatgtgattcatgatctcactgtcttccagcactcctaaaaatacaccggcagcaagaatggtagaagccatcataagcgcagggcccgcatgagatttgatgatcttattctgcatttttgcacccggatagttaaccagaagggcaatgacacagccgatcataaacatataataagacggcaccggcaggaaaacaagacaaacaatgataaacaatgttaaaatcacgttgaaggcaaacagcttcggccttaccagttctccggtatcagccgcagaagcgctttcttccagcccctcggtatcttctatggccagggtgctgttgattccggcccctcgtttcttttcaacaattccccagaaaaacgcggtaaacatagcaactccaatgcccaccacctgcatgggcaaaagcttcatccacaggacattggcttctatttccaatacagaggccgcacgcatggtcgggccgccccatggaagcagattcatgacgcccatggaggtgacacatattaaaagcagagttgtgggacgcatttttaatttcttataaaccggcagcattgccggaatggtgatcaggaacgtggaggcaccgcctccatccaaatggccgattatggcgatgatgcaggtcataaatgccactccaaccacattgttacccacttttttcattagggcgcttatgatgcggtcaaacattcctgcatcagtcataattccgaaaaacagcacggaaaatataaacaacgcagccgtggagtgcaccccggacacccctttcttaataaaatccccaacttcactgactgtaaaggttccggttaaaaccaggatcagggcacttatggtagatactccgataaatgcaagtgccggaacagtaacatttttcagcaacaaaacaatgatcatgataatggttgcaaatcctaataatgcaagcattgtctcattcatgttttcttcctcctctattctttttatttataggagcagtataaaagcccaaccttacactcttcctccttctctctttcatttctttaagagaaaaattaaaagttgttaagattcggcttttctgttatacccattccctgcaaatctttaccgcttttaaaatagatgagtcggaaaccggtttatctatgtactcatcgatgattttcctcttctttgcttcaaggatttctttggtcacccggtctgtcataatgatccggatcacatccggatattgaccctgaagagacatgcagaaatccgttccgcttttccctccaatataatgctccgtcacaatggcatccatttcttgttcccttaaaatccttctggcctcttcaaagtccatacaggacatcaatggcacatgcagcctgctgaaattcttttccagaagccttaatacctttggattgtcatcgatgaccagaagccttaagatatctccgcattcctcctctgtttccagctgcccttcctgctccttctgctcattcacaggaaaataaatatgaaaaacgctgccctctctctgcctgctttccgcgaaaacatatcctttgtgggaatgaacgatctgctccacaagagacagtcccagtcccgttccgttcccatttttctttgtggtgaaaaacgggtcaaaaatctgctttagcacctctttgctcatgccttccccgtcatctgcaatatcaatccggatataatgattccattcttccggaacggctgaaaacttgtactgctttaaatcctcctttcctaccttgttcgccgtgatggttatatttccttccctgtggccgattgcatggatggcattcacgcagatatttaatatgacctgattcatctgggtttcgtttcccagaaagcattcccctgataagtttatttctttctttaagtgcacatgaggcggacatacggagcttaccatttttatggcacgtcccagtaccttcgcggcatttatatttttaaaggctgtttccatattctttctgcttaaggatgagatctgctggatgatttcttttgcctttccggaggcttcataaatctccgatgcgctgtcgtatccctctgaattcttcggaaggtcaagcatcagcaattcggcatatcccatgatcggtgtcagcaggttattaaactcatgggcaatgcctccggtcatggttcccataacctgcagtctctgctgatgggcaattgtttcttcactctgatgcagttcttctaaaatcttattaagttcccacaaataggcgatttcttctgtatcctttcttttctggacccgcaaatccccaatataaaataccattccgagaaccactgcaacaattccgaaaaataccaggcccagcttgaaaaatccagctgcaaccgggatataaatatcattgtagtcgatcactgcactgactaccaaaaagctgtcccctatgacagcaggagaataggcgctgatcttttttacttccggaacccccgggtccagccaccagtaggaataatactcggagacacctgcctctcctctgttctgcttttctatcatctgctgcaggctggtcaaatccttattgggaaacatctcctgccggcctgaaatcacattgattccccactggctttcctgagggtgaatgaggataataccttttgaatccttgatcaccacatatccgttggttcccagacgaatattggataccagagacttgtaatatttcttttcatttaaaacaatggaaattgaactgccgtttagaagcattttctttaagatcaggtacaattccccattttccagtctgcactgccgaaagctcacaccagggctgatctctgtgacggaataagttgacttaaccccataaccattgatgctttctaacagctctccgttttcatcctctaaaatgacatcataaacaaaccggctgtgatgagtcacataatcctgaagcagggaccaatcctttcttccggctttttttagattttcatcttccatggaacataaggtatttaaatccgcctgatagtcttcaataaaaatttttaaactctccccaatgcactgggtcgtcagaatcatctgtttcttttgattgtctatgatcgcttctttatattccttccagatactgaatacaagacagcagaaaataagcagtacggctgccatggcacaagacataaataccgctccatatctcttattcccgtttattttgttcatgaatccatcctctgattgcctgttcctcattgacttgtctccgggttaatattataataattttagatttatttcgatctgtttctacataaatattaatttgggggaagctatgtctgataaagtgttaattgtagatgacgatccggctgtttgtaagttattggaaaaagtcatgcacagcaatgatttggaacctaccatcgcggacagcggacttacggcactgaattatcttaagaaccatacctatgacatgatcctcatggatgtcatgctgggtgatatggaaggctttgaggtaatcaaacggctgcgcagccagggcatccagactcctgttatgatcataagcggaagaaacgaggattacgattctctctacggtctgtctctgggtgcagatgattacatcaccaagcccttccgccctctggtcctcggagccaaggtaaaggcactgatccgccgaaataaaaatcaggtgctggacagctcggatctcctggaatgcggaccttttacttacaatacttccaccatgcggttttataaaaacggagaagagattgttctttcttccaaagaaagcagtctgatgcttttgttcttaaagcatccaagccaggtgtttacaaaagatatgatctacgagcatgtgtggggaaacagcgtagctgtggacgataatgccattatggtgtacattaaccgcctgcggggcaaaatcgaagaggaccggcaaaagccggcccatatcataacggtcagaggcctgggataccggtttatcccataggcctccggcctttttttctgttcaccagatattccagtgtggtagcgggtaccagaccttttaaccgttcaaaatcttccttttcataccatctccggactgcagatgcgctgataacctctcccctccaatcctttctttcaatttcctccacaaagattccatacctgggcaggatttttttcatttccttgttatattggcctgtaacaacacacacgggttctgttcccacaaagcgctttgtgatcccaagcgccggagcaatgcggctgccgaaaagctctaagtccagaccgcagcaggccctttctgcaccacccttttccttcatgaaataggttggaaacgtagctgcggatattacgtaatcagaagcctgatggatgaccgcccgtggtaagtccctggtcccttccctgaccaaaaaaaaccgttcctctgccccaaagcagctcctgtcatcgccaagaaccagaacatggacgtagtcacagcagctaagggcctgttcaatcaaataccggtggccataagtaaacggattgcagttggcaacgatggagccgatgaccatacctggcttcaatgcatcgtccggagactctgagatcaggcggttcacaaattcttcaaacccgtttttcctgttttccataaaaaggatatcatgggtcataaggactgtataaaatccaagatcctcaaacatctccctgttttccggctttgtgtacattaaaatatgggacctgctgctctcaaattcatactgggtaaggcaggagaggatggacccggataagccgagccctcgcgcgcttttatttactgcaatgcattttaagacattctggtccgccgatccggtggccagaatccggtaatcctcatcaagcaggcatacgctgtattcaatcccctggtcatagtccagatcattctggcttaaaaattcctttaattgttccagatcttttccttttaacggcctgccctccagcttcctgaattccataaactcctctctttccccggcccttttaccagttcaaccatgaatatggccaaagcaagaagatccgcacaccctccggcacttatattcttctttataaaatcctcatccaaacgtttcagcgtcagcatgcatttgtttgtgtaggctcctccggctcgcaggaaatcccttgcagtgttctggacctccataaggacggttggattatgccttgcaagaatgttggagtcctccacccggctcatgagcataaacagagtttccagcttgatccggttccagtcccgtccttctctgagccctttttccattgttggaagagcaattctacatacggaagaatatccgctgatagcttcccccctggcgccggcggttccgtattgatgcaggtttttttccccgttgctggtaaattcccgcatttcctttacttccttgatcagggtctccctcaccatggcctgctccatttccatcaggcgttttagggtcacggctccataagttccgatacatgccccggcagccccgcttatgatccccatgtgaaagatcagccccttgtgggtgttcaccccgtccgtggccttgtacatgactgcttccgcagacaggcccatcctgcgtatgcggtcaaacaggagccttggagtgtccgaaaacttaagaccttccagagccatggccgcaaaaaatggctccagagccgcagcgctccgctcaaaggaaacaacattcatatccttatgggagcctgaagagtacaagtccaccagcccgggcttaggggaagtataaacctcctcaagcattgcccggtaagccatattccctatatgaaaagcagtcttttcctctgtcctttgaggattcacacaagtaccggcggccatcttttattctcctttaaactgaaatcccctgatcttacgcaccacatccatgatggttccatcccggctttcaatgattcccactacctgatcatcaaattgtaccttttccggctctcctgcaatggagtatgccatatcccgcagctcttccatggttttaaacggcagatccacgcctttcatggattggattaagtcctgccttcttggattaatggcaataccgtaatccgtgatcaccgcatcaatggattctccgggtgtggtaaccgtggtgacctccgagcagaccaccggaatccttccctgcagcagcggaacgatcacaatggtgcattttgctcccgccgcagtatccggatgtcctccctgggcgccggtgatcacgccgtcagaacctaccaccacattgcagttaaaattcacatccacttccagagctgcaaggatcacaaaatccagtttgttcacaacagcccccttgttaaagggatcggcatattcccctgcgctgatccggaaatgcctgggattgattaccgattccactgcatctaaatcaaaatcctgtgtatccaaaagggcatcagcctgattgttttccaataagtcgcacatgggctttgtaagtccgcctactccaaagcgcatgcgcacatttctctccttcatgatttttgcaagagaaatggtggaagcgatggaagccccgcccactccggtctgataagagaacccatccttaaaataaggggtattcacaacaaaacgagtacaataatcagccatcatgagcttgcgcatatcagtggtcggctttgcggcaccggtggcaatcttctcaggatttccgatctcatccacgaccgccacataatccacctttgtcatggaaatatgggcggggaagttgggaaagggaacaagacagtctgtaacagccaccactttatcggcataatctgcgtccaccatggaataggaaagtacgccgcagtctgattttccgccgattcccctgcagtttccatagtcatcgcaggtaggggcaccgataaaggcaatatcgatcctcacctctcctgtttcaatggcacggacccttccgccatgagaacgcataacagccagcccctttaattttccttccgatatggccctgccgatcttcccgcggacgccggaagactggattcctacaatggttccatcctcaatgtaatccaccagcttatcatgggcctttccaagggagcttgcgcagatggtaatatcccggatccccatgttgtggacctcctccatcaccatatttaccacataatccccttcccggaaatgatggtgaaagcccagggtcattccatcccggatcttgcactttaccaggcagtcgtgaatgctgtccatcagcttgcttccctgggaattgatcacgcactttgtgacaggaccgtcctttttgtactcatatccatcaaaataatggactcccttaaagggctcctttcctgtctgctttaatatttcttccggaatctctcttcctgctgcattcatcatcttacaaatctcctttatacacaccggaggccttggccagttctatggttcttcttgctccgtcatagaacgcgatgtcaatcatcttaccgtccacggtaaaaacaccgattccctttgtctttttgtcctcgatttccatgaccaccttttccgcaaagataatgtcctttttagcaggggtaaaaatgtcatgaacaatggggatctgacggggattgacaatggatttcccatcaaatcccatcaaatgaatgatttccacctcccggcggaagccttccatatcattaagattggtataaaccgtatcaaagcactggacctttgctgccctggcagcaatgatcatgttctgtctggctcccatcagttcgattccggttccggtaatttgagtctgaagatcctttgtataatctccgccggaaagtgcaattccaaataggcgttccgaagcttcacaaatatccagcgccttcatcacccctcttgcggattcaatggcagccataatcagggtccttccttccggaatgccaaagtcttcttctgctgtccggatctcctcttccactgcttttatatcctcaggcctttctgttttaggaatccggacagcatcacagccgcctgccaccgcacagcggatatcctccctccagtaaacagtatccaggccgttgatccggaccacccgttcacagcctctgtaatcgatctcctgcagggcatgataaagggaaaaacgggctgcatccttctggttttctgcgaccgcatcctccaaatccagcaagagggaatccggcttataaatatacggatctttaatgagtcctggtttttgggcatttaaaaacatcatggttcttctgagccgtttctttttccgattcatcgctttcttttgtccccccagagaatattttcaaactggtctgcggaacggaataccgctccctccacacgcgccttaatggtacagtccagcgcccccttatccacaaccatgatcctcacattgtagattccaagactcttaagggtttccatgaccaccttccggatcctgttgccatattggtgtattaccgcgctttccagcgtaaaatcaatttttccatctcccggttcaacggttacctgacagtcgctggattccagtgtaccggccatagccggtcttttgatctccattttgcttaaagcctccctttttgtttatgatttcatcttatcgggagaatcttaaccagataaaaaaggaaccttaaaatttattaagaaagcggcagaatctcatctgccgccttcttttaaccagaaatctatgatgttttccatgcgtccgcaaagctcctccactccatggctgcggctgcggccgcacagctttgcatctttttcacaaatcaggcatttccgcacaggagcgcccagttcttctctgctgattccccttccttccccattgtatacatcaatatccaacagcctccccagaggatgggtctcttccattcgaaccgttatttttttaacagccagatgatccatgctttttactgcatacagtttcagataaccggccttttcttttactatgacttcttccagcacggacagcctgtttttaaaaagcagccggtccagctcttctccccctgcggcaaataccggcaaaaggcggggagaggtttttcttggacctggaacattcataccaagagccacaatcgtgaccttctcatacttttttctcagttcttcctgcatgtttgcctttttttcacgaaaaagaagcacttcttccaatgttacatactcttccattttacagcccctctttactctcctgcaatcatacaccatttttccttaaaaagaaatacatgaggcaggcacttacatttgcttgttatccactcaacggaagattgttctgatgtcaggggcttgccccatacagggtttacaggccatataaaaggctatgcccggcggcatcataaacggcacctgtccaggatcatctgggatcctgctgccttttacggtatctccgataattaaatcaacgaaatcttggatctgcgtcttttcgtgtactgaaatcctatttccagataaaagcacaaaaggcgctggcatctattcatgacagcacctcccgtgcattcttattattggttaacccttgggttttcaataatatatccttttacttactttacccaggccccattctcatcgacccggcagccgtccggcgtaaccgtattgatcaggcactctcctgactggcttaaataataccatttattatgaacattgatccagcccactgccatagatccgtccaggttcatataataccattttccgtctgataaaacccaatctgttttcattgcgccgctctggtccataaagtaccagatgccgcccacctgattccagccggtcgtcatataaccggtgtgtccaaaatagtaccatgttccgctgacctttacccactcttccctgggatacgttccatcctgtctttggaagcgccagccttctccatcctttttccagtctccctttgtttcatcggaacggctttttatgccatagtctctgtcagagtcagaactgccgccggaattctttcccggggacggctctggtgccgggttcgggttcggatttggatttggttccggttctggcgttggatttggatttggttccggctccggatttggctccggttctgggtccggttcattgataccaggcagatacgcaccggctccggcgttccttatgacactgtcctttgccggacgcaggaaatctccgaataggattctgccattgactctggtgaagcaatctgccggattcaaggatcggaaattatcggctgttatggcattggacccattttgataaaaataattgttgcttatttctctggcagcaattttatcatcgtataccttatcaagggaagcactataggattgggtgcgatatgatacattatttaccacagtgccgtcagctgttaaattcccctccaaacctgtcttataagggctggggcgcatgatgatgttgaaacgccggttgtcaaaagaggtattgttttcaatgaccagttctcccgggttaaaattatctgtaattccatccagatgattgtggaatgccacactgtttcttaagatatttccaacctcccggccttctcctcccagtttgaatccgttgttcccattattgtatgccacacaattttcaatgatggtcctgccgttgggaccgtcggacaaagtattatacaaatcccagccatcgtccgcattgtcatgagatacgcagtttacaaaccggttgtcatcaccggaaccggattttgaagcaaatccgtcggcattgatctttgaaccgtcgatattttcataagcctcacagttttcgatcaggttataagacggccacaaggttctgctgccccttgattttgtaattgtgaggcccgcatcactggaagtgttatggatcagagaatctttcatcacattgtggctgccatggatcattacacctctgcttccctccacattccggccgtccacgtcaagtcctgttacatcccagtaatcggaatccagaacaaagatctttccgcttcctgttatttttactgctcccatggtttttaaagcttttcttgcatccttgtttcctgacgagctgataggaatctggaaaggcccgtaggttccctctgccatgtaaaccgtcccgcctggaaccagcctgttaacggctgcattgatggacataggcgcattcatggttccctctccggaatcgcttccatcaggtgctgcgtataagtcatccccatagctttccttttttacctgataggtcaaaactttcgtttttcccgcgtcagcaccttcgtctggaacaaaactcagcttaaattccgcttcatccccagtaataacagccgggcaggtgaactggactcccccggtaacctccttgtttgccgcaatgactgttccgttctggctaacggtcatacggccggactgattggtaagagctgaaaccgtataagcagagccattggtataggctgctgaggccacataaagtgatgcggattcatcgttgggggccacataaaccggcgattcatctgcctgttttacatcacttaataccaatgaaatattcttcactgacatacgggcatttcttgccgcaaagaatcccacgtacataacgtcctgatctaagtgggccacgatgttaggagtgacatttttgtccgtaaaagtgtaggtggtcaccacatttcccccgtcatcaaggtgggaagcagtaaacccttcatccttccgctcaaggcgaagcttcatctgggttccatagtaattggacgtatagggagcttcttccggtgcatactttttatcagcttttgatacagacttttcaaaggttgctgtagtctttacagactttaaatttcctgccggactgttaactccatagcgggctgctgccagcaggtttaaatctgcgttcagggattttcccgccggtcctgtctgcagcattaccatgttggaggcggcaggatattcttcatatccttcttccaagggatcctttctgggggagccgttcacgtcacgaaccatgaggcctgccccttcctgctggtttggattggtcccgttctccggtcccatctgctctacagtgatatctgcagtcaggctgaaattcttattggcgggcacctcggcatagtagaaggtcaagccgtcatgtcctgactgcagctttccgcctcttgattcaatcaccacatcctggaccggacttccttccatacccagaggctcgccggaatctgccggccaggtataattaactcccaccttattgtccagcacattggaactgaagtttaaatccgtggactgtccgaatgcagaggatctccagaggatttcctcttccggtccgttccagcttcccaccgggccgctgttggtccagtggaacggtccgctcccatttaaggctttccaccaacggtctgctgcttctacacggaacgtgtgatgctccgccgggtccagccctgttaccgtaaaagacgtatcctttgtggtataagtaccgttgacatgattaaaataatctccttctgccgtatatacaggctttccgtctgcgtaaacccggtatgcgtagatacctgattcatcttccggttcatcccatgtcagaataaaatcattgccggacagagatacttctaacccgctgcttttccataccggtgccagataatcataagccttggttgtttttacggtttcctcctcatactcatagatctggtccgagtccgtaaatgcttccagatacacatcgttgctgtcttccagcatacggccgatggtcatggtgatctcttctgcctccggtttctcaagctggtaattataaaccgtggcggccagctcgccgtttacataagcccggtacccccgtatcctggaatctgccgccctggccgacttgaatctggcagttccccaggtgtatccgattccgctgaatgttacttttccatttgccggttctttgacctcccggtcttctcctcctgatgtgttccagtcatattggagccccagcaccttgtttcccggagcatctaccgcatatactttaaacacataggtcatgtcaggggaaagtcctcccagttcacaggaagtagcggtcacaggctttgttacgtcgatcaatacatcgtttacgtaagtctcaatgatatagccttttattccaccgctgccggtctcctgctccccgtcttccgcagcaggccatttcagcttcacccttcgttctgatccgctctttgaggcctccgacgcactggcaaccgtcaaaacatcgtcaggccataccggctttgccatggcatcataggaaaccgtggactgggtcgttgttcccgtaaagcttaagtcattggagaattttacggacccccatgccttataatcagctgctgccgcgtcatcagcctttttctcaatccctctccagttcatgaccacgttatggaaggctgcattggtcacacccgtcagcttttccgaggtttttgccagagacggatcaatgttggtaaaggtaatatcctgaaaatacaaatcatggtgagtgtgccatggctggtacatcttttcataatccactgatgccgctatttcaaacgtattttttgtgatggtatctgccgtaatattgtacgcatcaatctcatagaactccgccggcttatctgccggttctactgtcacggcctgattggcatcggagtaagacgtgctaaaggtaaatacctgctgggcatctcctacggcacagtcacggatcaggatatcagataccccgcctccgtttacaggagcgcttttgaagcggaacggcatgtcgctgtggtttaagacattgtcttccaccagcatttcaccaatgcccgctccggtgtggctgcctgctgcaatggcacctccatggcattcacggaggaagttattaaaggtccagatattgcttgacggcttctgttccgtatcctgaacgcctttgcccataccggtggcaaaattgaccgcatcatcgcctgtgtcaaagaaattgttaaaaaccattgcctcccgggtattgccaagctcaatgccatccccattattggcatcgtatgtaatgtattttacattttcggaaacaacgtgttcgctgtcaagaactgctatggtatggttagcaggattttccaccgtgattccttcgatataaactccttttacgccccgaaggacgatcagatttggcctcatggcataagcttcactgtcgctaagcccttttcctttccccatatcaaaggcactcttggccaatatgccaaaattactgctgccggaaaccttgctgttgcttcccgccacccagttctttaaagcatattttttaaactctgcctttgtccagtcaggatcaccgctttgtcttttctggtaagccggggagtaaccgtctccgcttatggtgcttccggaaccgtatttccagccattgccgtaaaccgtgccttttccaacaatgcggatattctcaaactccccgttctcatccgcgctgtaggtattgatcagggcccaggatctggtatcggtagaataaggatacagcagatagttctggtcataatggatcacatcaggagaaccaaaaagaactgccccctccttcagctccagagtcatgttgctctttaaatacagggaaccggacatatagattccctctgggatcactacctttccgccttcgctgcatgcatcaatggcgctctgaatggcctttgtgttctttacaataaaggcatcagtctcctcattgctggaggtaaagcctgcttcaaccttctccgctccgtaatcccggatatcaaatacttccggcgtccctgcggtggaccagacaatggaagccctgtcccccagttcggtcccatctgtatcaaccgctgcgacggaaaaagtataactggtgtcaggcgtgagcccatccgcccggaaggtatggatatctgtctttaccatatcgatcccctggtcatcataatatccgtaaaaggcgttcatatatgtattggcccagtccgcatgctttgcaaaattgcttcttgcatcacctatcttaacttcatcgcaatatacattgtaatttgccacatcctcataattctccggcttgtcccagaccagagtaatggatgtatcatcataagcaagctttggaactcttacatttgtcacgtcatagcttccttctgatctgctgtaacggctctcgcctgtcagtgaaagctcagcatcggatggagaggcagccgcaatcgatggggtagccgctgtctccagcatggagaccatcccatatgcctgtgaagcatcggcatcggatggggtggcagccgccatggatggggtagcttctctcatgccgtttcgtgctgaggataattctgcataagcagtccctccgccgtacgctccaaactggggcagcattgccatggcaaggaatacagccaatgccttcctgcaccgctttaatatagcattcatgtttgttccctcccaaataatagtgtaagcgcttacagcatgattttacagggaagaaactcattaatcaaccccctctttgaatttattataatttttgtcaataaatcccaataattataaatttttattgtgaattaagacatattattcgttaaattcattatgtattttatatatttttttcatatgattttggtcattatttttgattatcgagtggttaagcgcttacatttttcgacatttttttgttttaaggaaaactgaactgattttggacagattatcagaaacaaacgatacaatttttaagactggaattgactattggactgccggaaaatccgtgggcttacccaataagaaatcatggaagatagcaataatttctgaattgtgatagaatggatacagatcttttcccgcaaagaaaaaaagaattgcggacatttctgtatcaaaagagagcacactaataaagctggaaatttaccgggagaaaacctatgatcactttaacgaacagacaggcaagacattttatgcttctaaagcacgggctgctgggtgagcacaaatttaagggcaagcagggcgcctttgattttgtgcgccaggcaggctgtattcagtttgatccggtcgattcctgcggaaagaatgcggagctcacgctccagtcccgtgtcaagggctttacaaagcaaacgctttacgagctgctgtataatgaccgaaagcttgtggattatcccgacaaaaacctttccatcattcccaccgaagactggccatactttgaacgttatcggaatgccgcacgagaaggcggacggcgtttcaaagaactggcggaactggaagcaagcacgaaggattacatcctggcaaacggggcggtcggctccgacagcttacccatacagggcagcatacactggcattcttccattcattggagcggtaattggagcggcgataccaatgcgtcacgggcagtgctggaacagctctattctaccggtgagctgatcattcaccataaaaaaggctcccggaagtattatgacctcacccataagtatttacctgcacggctgcttgacattcctgaccccctgccggatgaatttgagcatcagaaatggcgtgttctacggcggataggtgcagtagggcttctgtggaatcgtccgtccgacgcatggctaaatattggggggcttaaaacacctcaaagaactgaagcgttcaaagaattacttgacgaagggaaaattctgcaagtcaaggcagacggcctgaaggacatccttttctgccaggcagaggatttatttctgatagaaaccgttttacaaaccgacacctttaagccccgctgtgaactgattgcgccgcttgactgtatgatgtgggacagaaagctgatccgtgcattatttggctttgaatacacctgggaaatctatactccggcagacaaacgcaaatatggtttttatgttttgccattgctttacagcggaagttttatcggacgtgtggaagcggtcgctgacacaaagaacagcaccctggttgtcaagaacatctggtacgagaatggaatcagacagacaaaaaagcttcagacagctgttaacggctgcataaaacgatttgcgaaattcaatgaatgtgatgtgattgattttaaatatccggacaaatgacaggttcctgctgcactcagtaagctttagggatcagttgtatctgcccaaaaatagaaatagccccgtcctgcaaaaaggacggggctatagtctcccattaccactttaaatttataaacatctcacgccgcttacctatatgagtatcttattatactctggcacaatatggtgtgggggaatttcctattttaattccggccaatattccttattggcttctatgagatcgtctaaaatctgctttgcaacagaggcgcttggcacggtctttgataaggtcagggcctgccacagctttaaatagcttccctctgtccaggcttccaccaccagacgttccactgcaagctgttcttccatcattcccttttcaaaggtaggaatgttcccctggcataatggctccggcccttcatttcctaccagacagggcacttccaccatggcggtagggtcaaaattagagatggcgcctttattttccacaatgcaaagcatctgctcacgggtattaaaggcaatggcgcaggctaaatccacaataaaggaagcgtgattgtcaatggagaactctcctccttttgcagtccctgcctgtataatggcccttgcggcactgaacacctctttttctcttccctccattacctcattggccctggtatgatcaggatctgtgtgctccaccacataatccggataaaggtaatattttaaatacgtatttggaagaaagtcaggttccagctttaataaatccgccgcctttttatgggtcagctgccagctggcatccatatgctgggtctccacagccttttccgtcagatatccgtttttagacacataatccaaaagctgaggcatgagatccgttccgtccttatcctttacgctggtccaccagccaaaatggttcagtccgaagtatttcacatccatatcctttgggtcccttccaacgatatatcccatgcgccgcttggttcccaccggcatgtcacagatatttaataccttggaatggggttttaacacccggcaggcctctgccacgatggaggccggattggaataattgagcatccagcagtccggagaatatttttccataagatcaattaactccatcatcccgccaatgcttctcattccgtatgcgatcccgcccgggccgcaggtctcctgccctaccacatgatatttcatggggatcttttcatccagctcccgcatggcatattttcccacccggatatgagccatgcagaaatccacatcagtaaacgcttcctctggatctgttgtataggaaaactccacctcaggcgcggtttccttcataacaatttctatggcctttgccagggtttcctggcgctctccgtcattgtcgtaaagttttaaagaacggatgggaaaccggtgcagattatccatcagcatcatgacaataccgggtgtgtaggtacttccgccgcctgcgattacgattgagaattttttcacaatattttcctccttattcttcctgttttatcagctgttttcgttgtttcccagttcctcgtcaacagcctttcttacggcagttacctttaaaccatagactacctgaacgttattgccttttttcaccacaccgtttgctccggtgccgtttttcagcacctcctcctgaaccaggtccggatctgtgaggatcaggcgtaatcgggtaaaacagttatccaccttttcaatatttccggcaccgccaagggccttaatgatcagcgcggcatccacgttttcgccgccttttccatctttctcagatgctaccttttccttgtactccgccttggtatgaagcttcatttccataccctcggtttcccgtcccaaagtctttagattcagttttgtaatgagaacgcggaaaatcgcataataaaccacaaaaaatataaggcctgtcacaatgtacatgggccatccggttttatggattcccaaaggcacgttgaaaagcaggaaatccaggaagccgttgggaccgatggcacggacgtttaaaacattgaggaccaccatactgagtccgcttaagcctgcatgaacagcaaacagaacaggagccacaaacataaaggaaaattcaatgggctctgtaacacctgcaataaaagaagtaaatgcggcagggatcaggattgcttttatcttattccggttttccggcctggctgtatggtacatggcaagacaggcacccataagaccgaacatcttggaaattcctctggcatcccatataacagaccgggacagcacctgaatggaagggtcagcaatctccgcataataaatgtttctcgccccctcaaacacctgtcccccaatggtttcaatgcctccaagagaggtgtataaaaacggggtatagaccagatggtgaaggcctgtaggtatgagaagacgctccaaagcgccgtaaataaatattccgaagttaccggaacggttgatgaatcctccaaggctggtgattcccagctggacaaaaggccatacgtaggtaagaagaaccgccagaaaaacggtcacagggatcaatacgatgaatacgaatctggaacctccgtaaatctggaaagcgttttgaaactctgtttcacagaaccggttgtgcaccatggcagttacaattccaagaataattccaagaaacacgcccatatccaggatctgtatccccagcaccatggcctgacccgttccccgtaaggactcccctgtaaacagaattcccgtcagggtcatgaacttgttcattgcattaatgaataccagaaaccctaaaagagcggtaaatccggcctcatattttttcttattggcaagacctgctgcaagccccacgcagaagatcagccccaggttatttaggatagataccagggagccggacaggatggcgccaaaaccctttgtcaccggattatctaaaaagggcagaagctccagcaattttgcattggtaaataaattccccacagcgattaaaatacctgcgatgggcaggatcaaaaccgggatgaacattgcttttgaaaagcgctgcaactgatccatcactttatctttcattctcttttcctccaactgtcaatgatcggttttcttttttcattccacgtgaaatacatatccgtattatagccgccgtttcaccctttgtacatactttgggaaaggataggaacctgttattccaagtggtaacatgtttcaaaaaaattccggatgccgctattttaaacgtcatccggaacctttattcttcttttttatccatattttgaagtaccttgtggtattcatagatcaatagctccatgagcataaacacattggggaaaaatgtatttgccatcatatttctgtcatccagcttattgctgtcctctatgcgaaactgcatatccgttatggaactgacacggttttccgcctcattggtaaaggaaacggtaaaaatgccgttctccctggctgtttttacccggtcagctacccagtccgtttcccctgaccgggaaactacaatgagcattttcatgttctccagattgttttcaaaaaccccgatggagtccattccattggaataaatgcattttatcccaaggacaagaagtttctttgttaagtattccactggaatggcggaaaaacctgttgcatacaaaaaaacatatcccccttccagacggcacagccgtctggcaaattcccggatgtcttcgtaggaattatactttagaagagagttggaacaaaagctgttgataaactgcattcccgcatcctcattgtccctggcccggtttacaagaggaagcagcttataatacatatccacaaacccgctgtagcccagcttttttgtcaggcgcatgatggtggaggtggaggtgaaattttcctttgcaactccccgcactcccatcttaagcatggaatccatgtggtcaatgatgtaacggagaacgccatcctccacctctgttaagttctttcctgctgtcagcttgcttaaatccaccattcctgccatccttctttcaaccctatctctctttctttataaaaaatcttcatacccctggatcatgggataaggagcacagtccttaaaaggcgaggttatggtccccttcacataggtactgaaccctgtgcggcgaaagtcttccttatttttatttttaatcagcctgccgcctttgccgacttctccgatgtaatgcccgttctggtcatagatttcccttccatagaatttcccaagaatccttccgtcacaggcggctaagtaatctttctgcctcacaccgatgtagtttccttgccaattccaatatcgttccattgaaatccatccttcctcttttcattctctgcaatcatacaccattttttcttaaaaagaaacactttagagaggcacattgctaaattttcaacgaatgctggatttttcccgggttctgttatataatctacagaaaaaatacagactaaccatatacacaggaggatgccatgggatttcaatatgtaaacaatctgccaagcccggaagagatcaaggaacgctttccacttccggcagaatttaaagcccttaaaatagaacgagatcaggccatcagcgacgtactcaccggaaaaagcgataaatttcttgtaattatcggtccttgctctgctgacaatgaagactctgtttctgattatgtaaaccggcttgtaccggtacaggaaaagacaaaagaccgtctgatcctcatacccagaatttataccaacaagcccagaaccacgggcgaaggatacaagggaatgcttcaccagcctgatccggaaaaaaagccggacatgcacgaaggactcatcgctatccgcaggatgcacatgaacgtgttcttggaaaccggtttatccacagccgatgagatgctgtatccggaaaacctgggatatttagatgatattatgtcctacattgccattggcgcccgttccgtggaaaaccagcagcaccggctgacttccagcggatgtgacgttgctgtgggcatgaaaaatcctaccagcggagacttgtccgttatgctcaactccgttgtggccgcacagcaggctcatgatttcacctacagaggctgggaagttaggagcaagggcaatccattggcccacaccatcttaagaggcgcggtaaacaagcacggccagtgtatccccaactaccactttgaagatttattccttcttcatgagatgtacagccgccgcaatctccagaatccggcctgcatcgtggataccaaccactccaattccaataaaaaatacaaagaacagatccgtatttccaaggaaatccttcacagcagaaggcattcccctgaaatccgttccttggtaaaaggcctgatgatcgaaagctacattgagccaggctgccagaaggtaggagaaggcacttatggaaaatccattaccgatccctgtctgggctgggaagatactgagcgcctgatttatgaaatcgctgaaaatatataatgtgctgttcttaacttaagatcatgccggggcattatggactgccttggcatgtctttttttgctgattactcttctcactctcttctgttattagtatttaaccttttttttaactatttttcaattttctcttgtttttcttaaaagaaatggtaaaatataattgtagtcatgcaaatgactcttcatcctgttgatatctcactaagaccctatgtagttgttgacacgtttatgccggatttatttctccggctatcaggaaaaggaggtatgggtatgcggaccattgaagtcgatatccagctgcgttacacccccattcccctcgcgcttttaatcaacaccgctaatgcctttgactgcgatatctatattgactacggtttaacaaaggtaaatgtcaaggactacgacgagatgaaaaaagggcttaacacgcagaatcggaacttacaatttaattttgacggcattgatgaacaggccgccgaaggacggatcgagatgttattccagccgtgatctgtcagaaaggaacctttatgaaccatcatctaaaagagagttgatatcagcgcttagctaatgatcaactctcttttcatttaattcttaaccgagaatggccgtaatgataaagtataaaaacaccaccgctcccaaaacaattctgtaatatccgaagaatttaaaatcatgctgtctgatatatcccattaaaaacttaatagaataaacggaaaccacaaaagccaccaccatgcctaaaaccagatagaatatctgaggaccggtaaagctcagcccatattttacgatctttaaaaagctggccccgaacatgatgggaatcccaaggaaaaaggaaaactccgctgaagctgccctggaacagcctaagatcatggctcccagaatggtggaaccggaacgggaagtgccgggaatcagggacaaaagctggaataagccgatccaaagagccgtctgataggaaatgtcccccaccttctgcacatcaaaactccggtactggttcctgttttcgatcacaataaacagcacgccatagaggatcaaggttacagccaccacataaccgttcatcagatattcatcgaggatatcatccaccagaaaaccgatcacagcagccggaatacatgccaaaataatcttggaccagagaaccagggtggcctgcttctgggccggctttttcctggctgaaaaaggattgagcttgtcaaaatacaggaccagcaccgccaggatcgcccccagctgtatcaccaccagaaacatgtttttaaaggcggacggctgatttaagtggatgatttcatctaccaggatcatgtgccctgtactgcttatgggaagccactccgtaaagccctccacaattccaagtacaattacttttaaaatctcaatgatattcattcctatacccctgtcttattatatattttcaatctgccagtcaataggctccagcccattgtcctttaaataggcattggtcctgctgaaatgcttgcagccaaaaaacccccggtaagcggaaagagggctggggtgaggtgcttccaggattaaatgcttaggatttgtgagcatgaccttcttgttctgggccggacgtccccataaaaggaataccatgggccggtcctgctcatttaagatcttaatggccgcgtccgtaaaagtctcccagccgatcccctggtgggaattggccgcatgggcccgcacggtcagcaccgtattaagcagcatgactccctgatcagaccatttctttaaatacccgttatttggaatctcacagcctaaatcatcccgaagctcctgataaatgttcactagagacggagggatctccacatcaggcttcacggaaaaacaaagcccgtgggcctgcccataattatgataaggatcctgccccagaatcactgccttcacattagaaaggggcgtgaactgaaacgcattgaaaatgtcgttcgggtctggaaagacctgggccgtttcatattcatgcttcaccttctgataaagttccctgtaatatggctttttaaactctttgcttaaaggttccagccaatcgttctcaattgctcccattttttctcctttatcttttccggggaacccccttttagtatacgaaagaatcaaggctcagccttaaatcctcattggtactcccatttcattcaaataccgctttaattccatgatttccagctccttgtaatggaacagggatgcagccaatgcggcatccgcctttcccgctgtcagggcatggtgaaaatgctccatggtgcctgcgcctccagaggcgatcaccggcacggaaacatggtccccgatgacacggttcagctcatcatcgtaaccggcctttgttccgtcacagtccatgctggtaagcaggatctcccctgccccaaggctgtctgccttcacagcccattctactgcatcaagacctgtgtcaatccgtcctccgttcttatatacgttccagccgcttccatctgccctccttctggcatcaatggcaaccaccacacactggcgcccgaatttaccggcggcatcggagatcagctggggagtattgatggctgaagaattaatggatatcttatccgcgccttcccttaaaagcattttaaaatcttccaccgtgcggatccctccgcccacggtgaaggggatgaataccttttctgccacccggcgcaccatctccaccactgtattccggttgtcagaagaagcggtgatatcaagaaacaccagctcatcggcacctgccttatcataagcggctgcaatctccaccgggtccccggcatcctttaaattcacgaaattaacgccctttactactcttccgtccattacatccaggcatggtatgattctcttcgtaagcatccggcacctcctaagtcagttcaatgaaattttttaaaatctttaaaccagtatcgctgctcttctccggatggaactgacaggcaaaaaggttcccccgttccaccgaggccccgaacttaactccgtactcggaagatgcggccacatcagattccctgtctgcttctaaataatatgaatggacaaaatacacatatgccccggaatcaatccctttgaaaagtcttgcatcaggcttgatatccaggcagttccaccccatgtgcgggactttaagccccggcatatcgggaaatctcacaatcctgccgggaagcagggaaagccctctcaccccttggcattcctcgctgctttcaaagaaaagctgaagtcccaggcatatcccaagaaagggtgttccttttgagaccacctgatggatcacatctaccagcccatactgatggagcttttccattgcatccccaaaggagcccacgcccggcaggatcactttgtccgcagaaaggaggagctccttgtcccggcttaccaccggattttcccccagcgcggtcagggccttctccacacttttcaagttcccagcatcatagtcgattatcgcaatcatggccgtcacctctttacgccttttttcaacattttaacacagcggcatacaatgtacaacgcaaaatataactataatttccgaaagaattccaaagaattttctaaaacgccatctgccttccctttcacagcctccggaagctgggaaaagctttcatgaatccggtacatatgagccttcttatttattgacacggtcttctcaaaaggccagcggatgaccgtgggagtctgaaatccaaccccaagttccaggaccagcagccttttgttaagggtccctgccagccatgaggtataggccttccactggggaagatatccctcttcaatgtaattctctgcctcaatggtattgcctgtaagtgatgccccgcagtggggacagacatcctccggaagttctcccggctcccatatattctttgtacaggatttggagcactgtctccatgttacgtttccgcagggcgccaccatccggctttgttccagggaggagtgaaagatctctccatcggtgacggttgtcacgataaaaaaatctttatccttaatgagcttttccatcttctcataaaggctcatgatatccggagagttttctgccttccattcctctccgattccgatcaaaagcttttcacaaacctttatttcttctaaaatctgttctttcacagtcattttcatccaccttttcttttaaacaattctcatttattatacatcaaaggatattttaagaaaagatggaaattctgtccttgcggcccgccatggatatatgctatactaatccatgcatttagtcaaataccctcagcagaccggaaggtattgggcccttgcggcattggcttgattcgtcagaatgcaaccatatccgcttgattcatcaggaaacaaataataaaaaaggaagtcagcagattatgaataagtttaagaggctttctccctttttagggagctgcgccgccattgcggtcctggcacttctgttagtcatatataccctgacaaaaccggttcccatggcgggaacaaaaagcatttccattgaagttgtatacgataatggagtaacggaccactaccagatcaccacggaagcgcagtttctgttagaagcacttaaatccataccggatcttcaaattgacggaaccacttccgaggaactgggcctcatggtcaacacaattaacggaaaacgggcagactaccaaaaggacggcgcttactgggctcttctctgcaacggggaaccctgcagctatggagtgagccagcaggccatcaaggatggagaacgctacacctttcagtataccttgtcctctgaggaaaataaaaaatcatgaaaaaccatcccctgtttaccaccagggagctggtattagacgcattgctttcagcccttttatttgtcagtcaggtggggttgtcctggctgcctaacgtagaactggtatccctgcttctaattttatacactctggtattccgcaaacacgtatggctcatcctgtacgtgtttgttatattggaagggctggtttacggcttcggcctctggtggttttcctatttatatgtgtggcccattctaccggccgccgtatttcttatctacaaaaacaaagcgccaaagctttatggtatatccctgctttccgggatctttggaatgctgttcggattattctgttccggattctacctcattgccggaggcgttggcgcagccctcacctggtggacggcaggaatcccctacgacatcgtccacggaacaggcaatttctttctgtccctcattttgtttcagccgttgtaccggctgctcacctcactaaaacgaggtttcattcaacgataaaggagtgtatgcttatggaatcagcaaccgtaagattgaaaaaaggagaaggccgcgctttaaaagccggcggcctgtggatctatgacaatgaaatcgataccataacaggagattatataaacggagacatggtaaccgtagaagactttgacggttacttcctgggccatggctttattaatacggattccaagatcaccatccgcatcatgtcccgtaaaaaagacaccataactgacgaaagcttcctggagatgcgagtccgcaatgcatgggaataccggaaggcaaccgtggatacctccagctgccgcctgatcttcggagaggctgatttccttcccggtatggtagtggataagttttcagatattcttgtggtggaatccctggcccttggcattgaccggctaaagcctgtgatcctggaaaaactgaagaaagttctggaagaggacggcataaaaatccgcggcatttacgagcgaagcgatgccaaggtccgcctccaggaaggcatggagcgcataaaaggcttcatcggccccgcctttgacaccaaggtggaaatcattgaaaatggagtcaaatacctggttgacgtccaggaaggacagaaaaccggatttttccttgaccagaaatacaaccgccttgccattcagcgattatgcaaggacaaacgggtcctggactgcttcacccacaccggctcctttgccttaaacgcaggcattgccggagccaaggaagtccttggggtagatgcctctgagcttggtattgcccaggcaagagaaaacgccgcattaaacggtttatctgaccgtgtggccttccagtgcgctgatgtttttgaacttcttcctgagcttgagaaaaacggagagaaattcgacgtggtgattctggatcctccagccttcaccaaatccagaaactccgtgaaaaacgcagtaaaaggctaccgggaaatcaatctgcggggcatgaagctggtcaaagacggcggctacttagccacctgttcctgctcccactttatgacccccgagcttttcaccaaaaccatccgggaagcagccgcaaacgtccacaaacgcctccgccaagtggaataccggacccaggcagcggatcatcccatcctgtgggcaggagaagaaacctcctattacctgaaattttacattttccaggtctgtgacgaaaaataaccggaattcaccaggatcataccatcctccctgacgttgagcctctcatcattgggcccttttcccaagcagtatttctgcttccatcatgttttctatgaccggtaccccaaatggacagcgctcctcgcagctgccgcaggctatacactcatcgccgctatgaagaaggctttgataatgggaacgtatggagggtgggacggcttttttatcaagcctagcgatgtctaagtatttgttcacagcggcaatatctatttcagaaggacatggctggcaatgtccacaatacacgcaatttccctcaaaagcgctatgcacttcgttaaaaatccaggaataatccttatcagcttcggctgccgaaagataactcatggtgtcatgtaattcagcccgtgttttacagcctgtcagaacactggctactgccggccttgaaagtgcataatggatacactgggccgaagtcatgggcttgctgtaaggcgtatgttccggggatagcagtttgccgccgccaaaggttttcattacagtaataccaacctgtttttgcgtacaaagcttgtataattccgcgcgcctgggatcaattccgttaaaagccctagcatcaaagccatgatcaagacagtcgaaaatgctcgcttttgaagaaagcatatcaaatgcgggattgatgctgaacatcatcatctccggcactcccgtgtcaatgacctttattgccgtttcagggttatgggagctaaaaccaatgtgccggatgtcgccttgctgttttaaacgctccacatatgcaacaaaatctgtctcaaagacatttttatagtcctgctccgagtcaataaaaaacatcatgccaaaatctatgtatccgaagatccgcaggagctcttcaaaatactgtttaaccacaggtaagtcccggctgatatcatactgcatatttacattcgtggagccgatatgcccttgcagcatcacctgatcacgcctatttccaatcgcttttgcaatattttcccgcacttgcgtaccaggcataaaaacatccataatattaacgccatactcaagtgcggcgtcaatcgtctcctttacctgttcatatggcttgccgtcaagatgttcgcagccaagaccaatcatgcttgcatgttttccggttttcccaacctctctgtattccatattattacccctatacttaaatatcgcttaattccctgacccgtgtctgatccgcctcttcttatgtctttaactgtaatttgcgggataaaatttttcgttttttactcccgctgactttcctgataccggcagagtctttcattatattatccctttgcattattataactgctataacagcacttgtaaacaaagagtcaggacatggtctgggagatgaagggtaattgcaaaaatggctgctgtaattcctgaagaaaggatttttatgaatggatggaattcacaaaaaatgccccgcaattaattgttacataattaattgcggagcagcatttcctgattatcttgattgagataccaagtttgcattcaaaccggtctgccattactctaagttcagccgcttggacaggatgcgctctgtgccgaaaaagaatatggcaagctgaattgcattgtaaataatcgatccgatgaaagccaggtgcatgactaaggccaccccctgtgtgtcgggcatcgtctcaatcatgcggaagaaggattgaaaggatggtacttttgccagtatgatcattgccaggccgtttataaagctaaaaagcatggatattgcaataaaggcgacaacggacatcatgattcggtgcttgccggaaagatggcccagtgccatggaaaagtacatatgataaagcttgacaagtccgctgacaatgaccagaatgatcagttcaagcacaaacagcggccaggacggaacctgagcaatcccgcggttgatgacagcccatatctggggatcagtaattgccgtaaaaaccctggaagggcctgcggcacccagcaccagaataaaaatggatacaaaagccgtcaggatactggctaaagacatcccaaatgccaccgtaccctttgctgcaatcagctgccagggcttcaccggcagggtaaacatcaaatagccttcatcacacagaagacccttataaaaccgctgaatgacaatgatcagcgtcagtacactcagagcaaccagaacgccgaagtaggcgatcacggagatcgtctgaatcaggctaagcagtccgtgtccaaagcttaaaccggacatcaggctgtcataatagccgttggacagagagcctatgcccataaacgcattgagaatggatatggcgataaccgccaggtaaatgggcgcaagggtgcgcacaatggatttgaactcatatttgcaaagtttgccaaacatcttatttcctccttttattagctgccgtaggcgaagatttcgcggaacagctgatcgactgacttgccttcctgctcccggatgttatctacggtgtcgtggcgcacaaccttgccgttttgcaggaaaatagcctcgtctaacacgcgctcaatatcggaaatcaggtgtgtggacagcatgactgtgccattttcgttataattggtcagaatcgtgttcagaatgaagtcacgcgctgccgggtcaacgccgccgatgggctcgtcaagcagataaagctgcgccttccggctcataataagcgcaagctgcaccttctccttggtacccttagacatggttttcagccggtcattggaccggatgccaagggcagcaaacatttccgttgcctttgcccggtcaaaatctacgtaaaaatcagcgaagaagtcggtcagatcacaggctttcatccagtcggcaaagtacatgcggtccggcaaataagaaatgactgacttggtttccacgccgggcgcattgccgtttacttccagcgtgccggaagtgggctgtaacagtccgcacaaaagcttgataaaggtggtcttacctgagccgttaggacccagaaggccgataatccgaccgcggcccaccgtcagatcaatatggtcaagcgcgggctttgtaccgtaaacctttgtcaggccgcgcgcagtaataagctcctgattcatacatgttcctcctttttattccatgctgcaagcagctcccgggtttgctcatcggtgtagcccagggcacgcatggacgcaagaaattcatccattcgcgcataagcaatctcttcccgcacactgcggatgagtgacagatcctctgtaacaatccgtcccgctgtgcggcgcgtttctaccagccccctgctttccagctctgccagggcacgctgcatggtgtttgggtttacacctgcctcactggccagcccgcgcaccgttggcacagccgcgccggatgcatatacgccggacacgatgcgcaaagtgagctgatcaacaagctgtatccatataggccggtcatcggtcagtttccagatcatgataccgcctcctttttgtattgttgtattaatcaactagtacaatgatacaattattttcctcatttgtcaacaggcagtttttaaaatgctgttttccctatattcagccgctgcaagctgctggcagattacgccgaaaagcgaatcaaatgactgtttatataaggattcccattatgacaataaaaatggggctgtaaaaaaacttccctaaaaaaatcgctgaggtcgtgagaccacagcgattttttggtataattaattatgcgactaaaaaaccacaccaatggtaattatacctcacgtcagttgaaattaccattagatatcgaaaaaataattaatgtttctgatccggtatacactttttgtgaggtgatggatcacattgacctatcaagatattttgtagagaagggatacaaaacaggtcgtccaagatgtgatgaacaaaaactccttaaagttatactctttgctttcatggagcacggcatctgctctctgcgtgaaatagaaatactttgcaggaatgatattcgatatatctatctccttgatgatatgaaggctccttcttttgcgacgtttgggaatctaattcgcaatgaattgacggattcaattgaacagatctttaccgatattaacagctacatttttaaaaaggatcaggtggatctggagcatacatatattgatggcacaaaaatcgaagcaaatgcgaaccgttatacctgggtgtggaaaaaatcatgtcttcgtaaccgtgataaagtttttgaaaaactatcggcattaattgattcgatgaatacaaatgttttagactatatgggaataaaacttgaaaagcgaaatgaatatgccattgattatgtcacagaattacttgaaaactataaaacagcaaccggcctggatatgataaagcttgtgtcagggactgggcacagaaaaagtatggagcagcgccaatatcaggagatgcaaagatttctggaacgtctgaaatcatatgcaaagcacatagaaatatgtggaaatgaaagaaacagctattcgaagaccgactgcgatgctactttcatgagaataaaacgggactatatgggaaatgaccagctccttccggcctacaatctacaggtggcgatatgtgatgaatacatagcaacagttgatgtaaaaccctacgcctctgacatggaatgctttgtgccgctcatggaaaagttcaacagcatctatggacattatcccaaatatccagttgcagatgccgggtatggttcgtataataattatctttactgcgaagagcacggcatggaaaagttcatgaagtttaccatgtttaaaaaagaaaccacggataagaaataccacaatgatccataccgggctgtcaactttaaaagagataagtcaggtgctcttatctgtctgaatggaaaaagatttaagtttaaatacaagaaacaagtatataaaaacaagtatggaagaacagaagaaatatacgaatgtgaaagctgtgaggactgcccatataagcctgactgctgtaaaaagaaatccgggaacagaaccatatgcatgaatcaggaattaacagcaatccaccaagaagtgatgagtaacctggaatccattcatggagcacttttgcgaatgaatcgaagcattcaggcagagggaacctttgggtaatcaagtgggataagtcgtacaaacggctctaaagacgaggcgaaaagaacgtaagtcttgagctcactttaatttcatgtagttataatctttacaagtatcataataaaaaaagccggttactgacagctgcataaaaagccagcgggatggaatcatttatccccttggattcccaagggtaacattgagtgcgcattttttgcttaaacaaagatatcataattatttttccgggcgaaatcaatataaaatttgaaataggattcatatcagcgttcgctgatatgaatcctatttcaggagggacttattttacagccccatgtcccatttcttattagattctatactgtttcattcagcctttacgggtaaaaatgaaaataaacaccgcccggagcagctcctccccgcagcgcggccatctcacttaccgtaaccaactggtatcctgcctccgtaagccttgggatgatttcaagggcagccgccccactctgggaataaagctcatgcatcagaacaatatccccgtcccgtacctgactcattaccgcatttaccgtctttgccgcatttctcgtcttccagtcccgcgtatcaatgctccacataatgacaggagcctggacatttgcaatgaccgtgttgtttttcgctcctcccggaggccttaccagggaaggcctgacaccgcaggcagcttgtaccgcatcattgcaaaggttgatctggctctggatctgagccccgtttaactttgtgagagttttgtgctcataagtgtgattgccgatctcatgcccttccgcagccatgcgctgcatttcagccccataagcggaaacccggctgcccaccacgaaaaatgtagcctttccgccatattgggccagacagtccatgatctgatttcccacaggagcaaatggcccgtcatcaaaggtcagagccaccattggcctggaagggtcaatctggcgtcctgccggcacctgttcctggctttcctgggctgccgtctcctgctgcccctctgatgttgttccgtcatttaagtcctgggccacagagctgttctgactctcatcactgcccccttcttctccttgcttacccggttgttctgaaatatttccattctcgtctacccacctggccacaccaggacccaggttttcatctatccagccattccgtacttccgccgcctcctggcccgatgctgtttcatctgccatagacggaaacggcgtagccggtacgaatgctgtcacaagtgctacggtcatcaaaccaaagccccattgtaatagttttttcatgtcacatctctcctttccttattactgcccatgctttttgggcatagaggtatagcctcagggtataaccctgttgccataaccactactatacaggaaacaagagaaaattggaaggagatttcccaacttaaataaaaaagttctggtggtgcagcagagcccggacaactgcatccatggttttttcctctgcctctacggttagcctgggctcatgaatgtcctccagatagtgggcatcggaattgcttatgatccggcagccctccagatatgggttccttttcctcagctcatgaagtttcgtaagatcctttacctctgccgtggcaaactggctgccaggaggcacaaatcctaagttggagagcaggctgttggctgacctgtcaatatgagccggaaacataacaccttcataagaccttaccagatcccacagttcatcaaaggagatatccacgctgttaataagaagatttggcactgtcccgcatactacatcttccttattatatatctgctgctttccaaatatttcctcattattggggaaaggcagcagccgttcatacacgtattcatcaaattccattgccctttcaaggctggaaaacaagcataccgcatgtacctcctcagaagtacagatttccattccaggcactgcaaggatcccgtattcctctgcaaaatgaagcacagccggacagtttttacaggaattatgatccgtcacagcgatcacgtcaagcccttttaaggcagccattcccacaatatttgccggtgtcatatcatcatccccgcacggtgataagcaggaatgaatgtgaagatcataggtcagattcatcatggggcagtctttggtagaccagcagggcggcctcaaagatgggcagctctgtttttaaaaccgtgatctcctgatccgctgccttttttacggctgcttcgtcaagagcagccccttctgccatgatcacacaggcagcgtcggcaagagaggccactgcaagagtatttatgttacccatcaccgttacccatgcgcacccctcagttgcccttcccattgcaatgcttaataaatcgcagcaaaacggttttttgatctcacggtcaagctcttctcctgcatttacaagttcaaacaaattgctgtcaatcaattctcttatcgtcattttgtttcctcccgtcttttctgtcaagctgagtcatttcatcagaaattctctggatgtactttgtcatgaccttaaacttttcatagctttcactgtcgccttccacaatatcggccgccagcctggaaacctcctctgacagcttatgcacattgtccctgaggaaataaacgcagtccgattctactgcctctccccgtacaatgtcttctgccagggccttgcaggtaggcgctccgcaggaaccgcagtctaagccgggaagcttctttaacagccgttccacctgattaagccttgcaaagctttccatcatggtttcgcctaaattaaacaccggctcatactggacctccttggtccactttaccagttcttctgctcctgcctgcatgtggctccttgccacaggcatgtacttccggagccgtttcagcttcacctccgccacataggggttttccaccgtgagcacgccgcccacgcagccgccgttgcaggcattaagctccacaaattttaaattggtaaatttctggtcctccatatcctccaggacccggatgacattttcaatgccatctgcagccagataatcctcggtaaacaggccgctggcctctcctccgctccggccccagctgatcccgatcttccctgaagtcccgatctcaggcgggtcatctcccaccgccttcatacaggataaaagcctgggatatacatcctttatggcaagcaccttatccacttcgctgtgctctgtaccaagaggagacttcacataagtgaccttggaaggacagggggaaatgaaaataatcccgatcttatctctttcaagtctggtcttttccatggctctctgggctgcaagaatagccgccacctccaccggagggtttaagggcagcagattggggatcaggttcgggaacttgacccggatgagccgcaccacagaaggacaggcagtgctgattgccggaagcttgtccggattttcgcttaaatactccctggtagcctcactcacaagctccgcagccgcgcttacctcaaatacatcatcaaagcccatcataagaagagcatttaaaacaatatttacatcatccagattgttaaactggctgtaaagggatggaggcggcaaggccactgtatattcatactgttttaaaacctcaagcttatcatatgtggcatgctttgcatggtgaggacatacccggatgcactctccgcagtcaatgcagaatttactgttgatctgtgccttcccgtttctcaccctgatggcctgagtaggacaccgtttgatgcaattgatacatcccatacaaagctcttcatcaagcctgaccgaatgataaaatttatccactttattacctcatttccgcattattgctcacgccttttgggcatagaggtatacccgaagggtgtttccgtgtgattacccacgccttttgggcatagaggtatgcccaagaagaagccttttatatattcaccaccatacgaatggtcgtcccttttcctatgactgtatcgatctccatatcatccgaatattttttcatatttggaagtcccattccggctccaaagccaagggaacgcaccgcgtccggtgcagtggagtatcctgcctgcatggcaaggccgatatccgggattcccggtccaacatcatttaagatcatctcgatccggtccggggttatgttaacggttatgtccccgcctttcgcatgaatcaccatgttgatctccccctcatacatggcaatggccaccttgcgaacagcttccggggtgacccccatctttttcagcttgcttttcacatcgctgctggcctctcccgcccttgtaaaatcatcgggagaaatgctgtaatgaaatgttatcatatccgtcattaaatagcacctccatgaagcccggcctcataaagcattccgcaggccgagaacatgcggtgtcctgttgacaggatgatgagacctcgctcctccgccatctgaagcatggattcatccggcttcttgcccctgacaaacacaatacagacaatgtctaacatctctgccgtacgaattacctgagggttgcacagtcccgtaagcaggactgaatgatccttggaaaacgccagtacatcactcatcatatcagaaccgcaggcactccggacctcttcatccaaatggtcctcacctgccagaacccgggcacccagtttatctttcacatctcttactgtcatattgacgctctcccttctttcattcgctctattcaaacaattcgcaccattattgatgattataccataaatagtccgtccggtatagaaatattacacggagggtttgttatttttttgtcgaatgttgattaaactatagattttttctcaataacatgttaaaatatcagttacattgcataagcaacatttaaggaggttatcaaatggcttgtaaaacacaaggcgtccagtttaacggacaaaagagcaggaagctgctttaaaagaagcaatttccctgctaagtgacacaaaaggatctctaatgcctatcatgcaaaaggcgcaggagatttatggctatcttccaatcgaagtccagaccatgatttctgacgaaacgggcataccgcttgagaaaatttatggtgtagcaaccttttatgcccagttcgcgcttcagccaaagggtaaatatcagatatctgtctgtcttggaactgcatgctatgtaaagggttccggagacatcttccataagcttgaagaacttctcggaattaccaacggcgaatgcacgccggacggaaagtattcacttgactcctgccgctgcgtgggtgcctgtggccttgctcccgtcatgatggtgaacggagaggtttacggaaggctgagcgctgatgacgttcctggtattcttgctaaatatgaataaaaaattgcgcttatgatgacagagatttctttaaacattctggatgtggcagaaaattccacacgggcaggcgctaccctggttaccattctcgtttctgttgatactgaggcagacaaactgattgtcaccattgaggacaacggctgcggtatgacaaaagaacaggtacttaaagtaacggatccattttttaccaccaggggaaccagaaaggtgggccttggcgtcccattctttcaatatgcggcggaaagcacaggcggaagcttttccattaagtcggagcctggagcaggaacagcggtgaccgctgtttttggactgtcccatattgaccgcatgcctcttggtgatataaacagtaccattgaaacccttatcacctgccatccggacacagactttctctatatctatcgttataaccaagcgtcatttgagctggacaccagagatttccgggaaattttaggggatatccctttgacacccctgaggtatcggcttacataagagaatatcttagtgaaaacaaattggaaacagacggaggcgcggccgtttaggcccgtcagatcaaggttgaaaaccatttcagccttaggtttgtgaattgaccggatatgcagacatatccccttgattcaccagtatggaaaattggaggaataacatgaagactcttgaagaattaaaagcaattcgtgaaaagatgcagggtcaggtcagcatgcgcggtgaagatcatggccgcacacggatcctggtcggcatggctacatgcggaattgccagcggcgcaagacctgttcttaatacattgtcaaccctggttcaggaaaatcagatgacagaccgtttttccgttactcagaccggctgcatcggcttatgccagtatgaaccgatcgttgagattctggaacccggaaaagacaaagttacatatatcaagatgacccggaaaaagcggaagaagtttacaaggagcatttactgggtggtcatgtagttcaaaactatacgttagcttcagctgacatcaaataaggaggaaacaggatgtatcgttcacatgtattagtttgcggcggcacagggtgtacttcctccggaagccagcagattatggtaacattaagagatgaattaaagaaacagggtctggatgaggaagtatccgttgtacagacaggctgccacggcctttgtgccttaggccccattatgatcatttatcccgatgccaccttctatgccatggtaaaggaagatgatatttctgaaatcgtaaccgagcacttattaaaaggacgtcctgtggaaagactgctttatgatgagacagtgactccggcaggaatcaaggccttaagtgatacggatttctataaaaacagcacaggatcgctctgcgcaactgcggtgtcatcaacccggaggaaattgaagaatacatcggtaccggcggataccaggctctaggaaaggttcttacggagatgactcccggcgaagtgatccaggctctcttagacagcggattaagaggacgaggcggcgcaggctttccaaccggccttaaatggaagctggccagccaaaacgatgcggaccagaaatatgtctgctgcaacgcggacgagggtgacccaggcgcatttatggaccgttccgttttagagggtgatcctcatgcccttttagaggccatgactattgcaggttacgccatcggcgcttcccagggctacatctacgtgcgtgctgagtacccaatcgctgtacagcgtttaaaaattgccattgatcaggccagagagatggagcttttaggcgacgatatctttggatcaggattttcctttaacattgatcttcgtttaggcgcaggcgcatttgtctgcggtgaagagaccgccctcatggtttccatcgaaggcaaccgcggtgagccaaggccacgtcctccgttcccggcacaaaaaggtctgttcggcaaaccaaccatcttaaataacgttgaaacttatgcaaatatcccacagatcatcttaaacggcccggaatggttcgcttccatgggtactgagaaatccaagggaacaaaggtattcgctttaggcggcaaaatccacaacaccggactggtggaagttcctatgggaaccacccttcgtgagatcattgaagagatcggcggcggcattccaaacggcaaaaaattcaaggctgcccagaccggaggaccatccggcggctgtatccctgtggaacactacgatattcccattgattatgacaacctgattgcaatcggctccatgatgggctccggcggtctgatcgttatggatgaaaccgactgtatggttgacattgccaagttcttcctggaattcacggttgaagaatcctgcggcaaatgtaccccttgccgtatcggtacaaagcgtatgcatgaaatccttgacaagatcaccaagggacaggcaacgctggaagacttagaccgtctggaagagctgtgctattacgtaaaagaaaactccgcctgcggccttggacagacagcaccaaacccggttctttcaacccttaagttcttccgcgacgaatacaatgcccatattgttaacaagacatgtccttccggtgtgtgcaaagcgctgctctcctatcacattgacgctgagaaatgtaagggctgtactctttgtgcaagaaactgtccggtgaacgccatctccggttccgttaagaacccacatgtcattgatcctgagaagtgtatcaagtgcggcgtatgtatggagaaatgtaaatttgacgctgtctacaagaaataatggagggaaattggatcatggagaatatcacaataaaaatcaatggcatggaagtaagcgctccggccggctccaccattttggaggccgccagactggcccatgttgagataccgaccttatgctttttaaaagatatgaatgaaattgctgcctgccgtatctgtactgttgaaatcaacggtggcagactggccgcttcctgcgtatatcccattaatccgggtctggaagtattgaccaacacgccaaagctgcgtgactacagaaagaaaacccttcagctcatcctttccaatcatgaccgctcctgtttatcctgtatccgcagcggaaactgcgaattacagaccttatgcaaggaactgggcgttgaagtggatgattattacgatggcgctaagacaccttccactcctgatgagagtgcggcccatatggtccgggacaacagcaaatgtatcctgtgccgccgctgctctgctgtttgtgaaaaggttcagggaatcggcgtaatcggccccaatgaacgcggctttgccaccatcattggttctgcctttgaaaagggacttggggaaacaagctgtgtatcctgcggacagtgtattgcagtctgtccgaccggcgcgctctatgagaagagcagcattgacgaagtagctgctgccatcgcagaccggtcaaaacatgtgatcgttcagaccgctcccgctgtccgtgcagggctgggagaggaattcggttatcccatcggaaccaatgtggagggaaagatggttgccgctttaagaaggctgggctttgataaggtatttgataccaacttcagcgccgacttgaccatcatggaagaagcccatgaattcattgaccgtgtacaaaacggcggcgttcttcctatgatcacctcctgttctccaggatggatcaaatactgtgagcactacttcccggatatgacagagaacttatcttcctgtaaatccccgcagcagatgttcggcgctattgcaaaatcttattatgcggaaaagatgggcttaaagccggaagaaattgtatccgtcagtgtcatgccatgtaccgctaagaaatttgagatcggcagagacgaccaggatgccaacggctctcctgatgtagactattccatgaccaccagagagctggccaggatgatcaaacaggccggtatccggttcacagagcttcctgatgaagattttgacactcctttaggtcttggtaccggcgcagccgttatcttcggtactaccggaggcgttatggaagcagctttaagaaccgccgtggaaagcctgacaggcgaagagcttgaaaagcctgatttcgctgatgtccgcggaacaaagggaatcaaggaagcctcctaccgggtaggcgacatggatgtaaatgttgctgttgcttccggcctgggcaatgcaagagaactccttaacagagtaaaatccggagaagcaaactatcatttcattgagatcatgggatgccccggcggttgtgtaaacggcggcggccagcctcagcagcctggctttgtgcgcaatacaaccgatatccgcagcctccgtgcaaaggtcctttatgatgaagacgctgccaagaccatccgtaagtctcatgaaaaccctgcaatcaaggaattgtacgagacctaccttggagaacctggaagcgaaaaggctcaccacctgctgcatacaacctatgtaaagagaaaaataaacgaaatttaatttcaaaaactccctctgccttaaaacagagggagttttctggtttaacaaaaaaagaattagccttgaagtgaatggattgtataaaaacctccatactaagactggaggtgatgaaacatgagcccaaaggaattaacttatattgaagatgctcttggccatgagacttttttaaaaacccagtgccaggaagcggcacagaatctgcaggatccggaattaaaagcttgcgcacagcagcttctccaacagcaccagcagatttttgacagcttctataacttagtgtaaggaggaatcacatatggatgacaagtgtattatggagaacctgctccacactacaaagggagtgtgcgacttatatctgcatggaaccatcgaatcccctaccatgaacgtgcatcaggcatttgacggagcattaaatgacagcctgtgcatgcagagcgatatttacaagaaaatgtccgcaaagggatggtacaccacagaacaggcagagcagcagaaaatttccaaagttaaaaaccagttcgctgggatgtaacaaaaagaatggcatgctgcaaaactaattatctgattagttttgcagcatgccttttattcttacatataaaattcccctcagctgccgtatcaatgcaatgccctgagctccgccataatttctttatagctgcggcccttgccaaacagggctgatgttccaagtataaacccatccactccggcctggtacagctcctgtatcttttcaggagaacaggctccatccaccatgagcttaaaatgatactcccttttatggataccagcttctgaattttccgatctacaaatccaatatatttttgccctgcaaaaccgggattcacagtcataaccatcacataatccaccaattccagtaagggacttacggtctcaacggacgtccccggattgatcgctattcccggttttgctccggcatctatgatcttctgcagggtcctggcaatatgtacatcagattccggatggacataaataatctccactcccatctgaacaaacttttctatatagtccccggattttctatcatcaaatgaatatctgccggccggccggctgttcgtgcaatgtattcaatgtcctgaagtcccatgccaaaattaggtacaaattctccatccatcagatccaaatgaaagatatccgcccctgcctcttccaggctcttgatttcctgctccagatttccataatttgcacacatcatggatggacataaaatcttttcattcattaacaacctctttctttctgtttttactgaagcaaaccacctgccttctgatcttatacaaaatcaaaaagctagtaatcagaactgtaagactgtaacagagcagcagccagaaggattgctttcccaataaaacgcccgtcagcctgatgccggtcattgcagccgttgtccccataaatttcctcatattccagcttttaaaataaatgagcatcaggcagatcaacgcagaaaccatcaccatactgcttacttcataaactgctgacagaagaaattcccttccgctgatcccctgcaggaaagctgctgccgcctgcactgattcctgacccgcagtgctcatctggctcatggttccattttcagcagccattaagatggaaagatcagcaataaacggaatacctgccaaacatacggactccaggagcccccttccaaaaccgatggaaatggcggccttgtaagagcggttatcttttaggagataacgaaacagcaatacaagggacaaaatatccaaggctgtggaaagggtcgccgttataaccatggcaggcaaacttccattcataaatgaatatcgtttcaatccatttaaaaggaacggcactgctcctgcctgcaccaccagataaattccggctccacacgcaagcagtttaaactgaagcttcttccttgctcccatatgcagcataatcagaagggggaatactgtgcttatcatcaaagcaagatacagactgcctgttactccgattttcatgatccttactccccggttcttctgttttgctataattcttctccatttgtttcaatcacctttttataccagtagaagctctttttcggtattcttttaaagtcatcatttttatctacataaacaaacccataccgtttgttaaatccttcacgtgtagagtacaaatcaatggccgaccaggtcagatatccgattatatccacgccttcctccaccatttctttcattcttaaaatatggtcacggagaaattcaatccggtatccatcatcaatgttcccgtcttcatccggcacatcccggtacccataaccgttttccagaatcaaaatagggatttgatacctgtgataataatcttttacaaaatgcttgaatccataaggatcgatgttccacttccactctgtctgcttaagatatggattcaccgccttccggttggaggctgataacagcttctcttttccttcatcctttacaatgctgctgtgataataggtcagggacagaaagtccggctccgcctgtgcaatgatatccaaatcgccgggcaggattatctgatccagattgagcttttcaagagattttaaataaaagccggaatacatttttctgacatatacatccccataattgtaccccaccagatacttatactcttcacaggcctccacatcttctgccctgcaggtcgccggatacgggcagatattgcctatattgccgcctgtctttgcctggtgatcaatttcatggatcagctttgtacaccgcgcgtatgcaaggttcatatggtgttctaccgtaaaggattcctgtctgtccctgcacttgtatccggtcatataaagggtatcaaacatcagcagattctgttcattaaacggcacccagtattttacacgccctttaaaggcagtcaccacggtcctgacatatttcaaaaattcatcaatgcaatctctggacaaaaaaccgttgtatttttcaaccagatgatatggtaagtcgtaagcataaagggttactaccggctgtatgttatactttaacagttcatcgataacattgctgtaaaaatcgatcccttcctgattgggctccccatcgtctccgttgggataaatcctggtccaggccatggtcagccggtaaatctgaaatcccatctgatgataataggcaatgtcttctttataatgttcataatgattgctcgcctgtttgaaatcatcaaagtttgcctctgctgccgcatttggaatcacccggacatctgcaatcgaaaggcctttactgcctttgtcataccctccctcaaactgctgggcgttcgtcgaactgccccacaaaaattctttgttaaacataagatactcctcattttactaaagatcttgccacaatcgcctcaatttcaccggaaaactccactctttctcccggttcaagcacaatcgtcattcccttatgtaccatcactccgctaaccggactctcccctccgataaccgtaaccatttcaagccggtcagacacattgcggcagcttctgcctttcaaataaccgctccagtatttcttctcctgatggccggcttccccggataataccgctgactttaaactcacatcaactgcctccagagccttttcaatatgaagaggtctggaatttccctgggaatcctttctgccataatcataaaaccgatacgtcaggtcactgttttcctgtacctcataaaccatggaacctccgcctaaggcgtgcagcgttcctgcctccacaaagacatagtcgccctttttcacctccagatagtctatgatatgttcaaaatcattggagcaagctctttccaccagctcatctctgccatagcacagacagccatttacaattgtccccggtccggcgcctccagaaaataccaggattcggtttttccaaaaggctgctgttccagttttgccgcacagctgtcatttggatgaacctgaacacttaagtcctcttttgcatccacgagggcaatcagaaggggatattcctcaaagctcatatcaaaccgctgtctcgcatcctggtaatatttatagaatgtttttccggcataacttccgccaacgatctggttgctgcagtccttgttgcattttacggtataaagctgccctatgttttctcctttatagcctttagcatagggaatcagcctggttcctccccaaatagttgccatggggatgggttttaaaatctgcatagttattgattcctcttctttaatgtcaatgcctgtttcagcacattttttccattgcaggttccgtaatccgatgactctatcacatccacaggtatccggagtctgactcctttcgccttcaaagcatccgccatgaatttgatctggggccctaacagcaccacatctgctttctgcatgttctcatccgcaacatcggtggaaaccgcccagatcttacaatcaaagttcaattcctttgccaccttctgcatttttgtgaccagcaaactggtagacattcccgccgaacaaattaataaaatattcatacaacacctctcattctgccgcctctgcagcttatctgtcccggaaagaaccctcggcccctccggtttcagctacctgtactcaggctctaacctgcgaaattcaaactctttcttctctccgatttcgtgaaaccaatgagcagattttttcatatgtcttgcaaaattatcttccagatcgatctctataaatccataacgatttttaaaggaatttaaaggagaaacacaatcggtaaaagcccacagcatatatccggtacaattgcttccttcttccaccgcctttaaaagccatgccatgtgttcgctgatataatcaatccgataatcgtccacgatcattccgtttcggtctttatactgtttttctccttccactcccattccgctttcggaaatcagccactcaatgttcccatattcttccttcatgcgaatagccatatcatacatgatcttcggatatatctcccagccgcgatggggattcattcttcgccccggcagttcatgaagatcaaaaaaataactcggatgaaacggtacgtccggattccatgcactgttcctggcttttactctcatgggaaaatacagattcaggccgatattatcacaggtattattctttatgacttccagctcctggccagtgctgtcaaacatacagtgatgttctgttaagatctcagtcaattctttggggatctctcccttaacagccggatcaagaaacatccggttataaaacaaatcatacatctgcgccgctttttggtcatgaggcgcatccgacctgggataggcatattcaatattgatcaccaccccgatcttcccatccagcttcaaactcttatatgcttccacggctcttgctgttgcaaggattttattataattccactgcatcgccagcggggtatcctgtttgaacggaaaccgaagtccatccagaatcgtacgggtctgtacaacaataggctcattaaaggtaaaaaactgcttcacctttttaccgtaccgtttaaaaaccgcagctgcatatttcacatataaatcaaccacatgcttgctgccccagcctccgtacgtttcatacagttccccggggaaatcaaaatgttccagacatatcatcggggtaacccctttttccagcatataatcaatcacttcatcataaaacgctgcaccttccggatcaatctctccggtttccaaattatagataaatctggaccagtctatggaagtccggtatgctttcaccccgcttttcaccatcaggtcaatatcttctttaaaatgatgataaaaatcagttgcggccttaggcccaatctgattgtgccacagttctggggcagacttataccagagatccacaaacgtatcatgcccctcttttttcccataccagccttctgtctgccatgcggaggaagccgcgcccaatatgaaattatccggtattctgtatttatcctgtatcattttccacctcatgtccgctattgtctttctgttctcttatttcatggagtccgccaatgcctggagatcatccaaagacacttccgcttcctgcatttcttcttccaccttttttctgtcccagatcttcaaaaacggatagtatacaacaattgtgataatcaaattaacaagctgcacaatcaccgctctgaagtctcctcccgttgccagaaatcctgataaaaacacaggcactgtccagggcacggccacgccgaccggataagtacacaaaccaagagccattgcaaaatatgtggtggttcctacaagcaaaggtgcgatgataaacggaatgaccatgatcgggttcatgataatcggaaggccgaacaataccggctccgcaatattaaacacaatcggtccgatagccagcttgcccaatgatttgatctgctttgactttgctgtaaataccatcagaattacaagccccatggttgcaaggcctccagcattggtaaagcagtcatagaactgttttgtaatgatattgggaagctctcctcccacctcaaacgccgctctgttggcttccatggcgggaagcaaaatagaatccattacaccaaatacaacacggcttccgtgaataccggtagaccagaataaatgaattgctcccacggttgccagcatgccgccgtatgacagacctacctttgataatggcgtggcaataaactggttaataaatccgaaaatcgtctcaaaacctgtgccctcaaacagcatccttaccagccagcagatagtcagtatgatcattgcgggggtaattgctgcaaatgattttgcaactgcaggaggtacgctgtcgggcatcttgatcacccagttcttttttacaacaaatgcatatacctctgcgctgaagattgcaaccagaatgcccactaccaggccgcctgctgacaaatacgtattggtctggatgacccgtcccagattcagtgtggtctctcccataactgcatctgagatgttaaaaactggtactaatgacaaaaatgccgcaatagccacgatcagggaagacaatccatccacttctctttgcttggctatctgatatgcgatggaacccacggcaactaaagtcaggatatcaaaggtcgctctgcatggataattgagctttgccacaaagccgtctccgaatatcccgttcataaagtccccatacccctcaattggaacatttgccagcagcataaaaattgaccctacaattacaagcggcattgtcacggccagaccatctcttaacgcacggatatagcgcattgcagctatccttgacgcaaccggcattactctgttttccaagaaactcattaaacgattcattttctctcctcctgtttctcaatcaatgttactccccttacaatcttttatcatgtggtatacatgaatcagctcttcagccctttcttttgccatcattgccattgttaaatgatcctgggcatgcaccaatataatgttgacctctaccggtctgcctgccgcttcctgctggatcatatcgatctggcactgatgggcaagtctcatctgtgcttctgcttcttttaaatactgttgtgctgtcacaaaatcaaattttctggctgcttcgattgccatcattgaagcagactttgaatctcctgcattcataatcagttgaaatgcgacaccataatctttttcttccaccttttattctccagtcctttactaaatttcttccagctcctgctccactctgcccaattcccggatgaactgatcataatcccttcttctgatcagatcctgtatacgctgttcatccaacaaaaaattagaagtgatctgataaaacttttgtaaatctttttcttttctgtcctctatcagtaccaggaataccaccgagacatcccgttccgtccaacgtaccggttcatccagaactgcaacgcatacataggtttctttactcatgacctggtacggatggggcattgccaccagattgccaaattccgtctgggcaaactcttcccgtttcatcacggaatcataaagagtatccggcaccccaaatgctgcaccagataattacacaaaaaccggagaatctcttctttgcttttcatggaaacatgaggcagaaaaatatcctttctgtaatacttctccatggaacttttcatatttcccgacaatacttttctgacattttgtatatccttactttctaagaaaaactgtacattctgtataggaacaggtattttaacggaaatgggaactgtcgcaaacacatagtcaatatcagaaaaatccaccagatcaattgtggatacactgcatgtctcaatcctgtttaaatacattccgaattctttctgatacttatagaccaacagctgggcgctgcccttgccggaagagcagaccagcaaaatattttttttagcagctgttgttttctgccgctctaaggccaatgcaaacggcagcgcgatataggcgatctcgtcttcgcttaatttcctgtgatacactttcttcaataccccggatgcctgcgatgccatcgcatagggaagggaaaaatgttccttgatttcctgaagcagcgggttattcaaatttaaattgtacttcattctgacttccagcggcacgatatgctgactgagtgacatcctcagttccagatcgcctctgaaatcataccggaaagcatcgtaaaccacttgcagcatttctgttacaacgttgctgatctgccggctgatcaccagattgtcattttgccggccggactcaccatagttcatctttccagccagatgaatggtcacataaccgatttccgaatccggaaaatccacgctgaacaatttcttcatttcctgtacaatctcaactgcaatccggtattcctgccgtttaataagctcctctaaatcttcctgtttcaatgatatttcatgttcctctctgatcctcatgacagcaatgtacaaatgcagtacaagattttcaaatgccacatctgatatgatataatgatttcttctcaggcagtccgaaacacagtccgcaattgtccccagggtcttcaccggtatcagattctcatttccatggtggacaatgcatcttcgcagttcaagctcttctccctggattttgatcccataatatggtttcctcatcaacagcagatcgtattcctgaagtattgtttcaacctcctttaaatcatgactcagcgtcttttttgaaatgaacagtttatcacttaattcatccagttttataaaatcttttcttcctaacagatatttcagtaaaaaaccgatcctctcttttgaagaattgggaatttcctcataatcggaatttcccccgttgtttacaaagctttgaaatgcttccggatcatcaatcacaagacgataaccaagtctggattttgactctaaatgggcgccttcagtcaaaatcttttcccccagtttttttaccaggtttcttactgtcttcacactcaccttcaaatgaccagacagccactcagccgtatggtaatcttcggaatttaaaagctgcaacagcgtattaaatcttttatctttcatgataatccttcctaaaaacttaccgtaagttttacattcaaattatagcattgtgcatattgcacttcaattaccatttcaagcataataattatggtatttttttcttttcactctatgcctatccgcttataccccgtattattggactttttttcgtttctcatttgcagaattacgcaatgtactgttttatggcaaaaaaagaagagcagctgttcaacgaacacagctacccttctttttctcatttgacaatcaatgcctgtgcatgggaaccatctgcagtccctggctctttaagttctcatgaacctcccttttgtctgcctggccaatgagtaagtcacgggctctttttgcctcgttctcactcttatacctgctcggaccgcctacacagcctcctacacaagccataccctcaatgaaatctccaggaagccggcccactttaagcagcataagggccttcttgcattcagccgccccattgcattttagtacttcaatgtccgtactttctcccgattcctttaagcattccaaaacagccgctgtcacaccgcctccgtttccaaaacgctttccaaagaccgaccccgcctggtaagtgttctcctccggctcaagctttacaccctttgcttccatcattgcatggacttctcccagagtcagggcataatctgcattgtctataatattcaaatccagggtctcactcttcttggcaatgcacggcccaatgaatacggtgatcacctcagggtacttttcctttaccattctggatacggcacacatgggggatacggtggtggacatgttctcaagaagcatgggataatgctgcttgatcatgttcacaaatgccggacagcaggaggtcgtcatctttttgccttccttatgggcgatcgcccactcctccgcttctgcggcagcggtcagatctccgcctaaggaaacctcgatcatatcctggaagcccaccttctttaaagccgttctccagcttgccatggtgatatccggaccgtattggccttctgttgcaggagcgaccatggctaccaccggtttccctgcattaatcaggttaatgacatccaccaaaaaggtcttggaatcaatggcaccaaagggacagccgtgaatgcaggctccgcactggatgcatttgctctcgtcaatgaccacaatgccgttttcatccattgtgatggcatccaccgggcagcttttcttgcagggacgggtcaaatcggcaatggcgttataaggacaggcctgagaacactttccgcattccttgcacttatccggatcaatgtaggcacggtcacgtcccatgctgatggcattaaaattgcaggaaccctggcacgccttgcccatgcacagctgacagttatcggttaccacataccgggtaatgggacagtcctcgcaggccgagctgatgacctgaaccacatttttcgtgtcctttccgctgggacagaggccttccgccagacggattctctctctgatgatctcccgttccctgtagatgcagcagcgaaactgggctttggggcctggaatgatcttataagggatctcattccttttttcctccagttttccttcccatgcaagctctgccacttcatttaatacctgatgctttatgcgaagtaatgttgcatcatttgttgccatatttttcctccttgtaacttccacgctcaatggccgtgtgaatatctgccctgatttaataataggttaccgtaacccttttccccatttcttccactacgtgttttaattgctccacaagattctggcggatccctaaatcaaagggcaggccagggttctgataagcgctgttaatggcttttcccacgtacaagttaagctccgtacaatcctcaatgatcatcttcgccaccatggaagcgccgttaggcttatccagctccaggaaaaattcctctgtaacggattcattcttcacataacgtcttaaaagcttcaagaccttgtttaaggtcaaaacaccttccgtaaccagttcaattccgtcgatataggcgataggcggaatatccgggtcattataattcagagagacagacagctttttttcggtcactctggaaacaatattggcactggttcccccgcagacgatctttttgacggtatcgtctcctgacaggaaatcctccaccatacagctgtcatcctccggcttcctgggaggacctgtcatcaaatgcaccgtcttcctgtcaatgatcctcataacggcaaccgtggtatcatcaccgggctgatactgatacagctcatcacaggcacggcttaaaacagcagcaaggcgcgccgcggatatggtcagacggtactgcttcaccgcataggaagcaatgtcatcccacagccagccaaagtttaaaagctggcccacccccgcatggatggtcccatcgctcataaggatcagtgcatccccctttttcaccctgaaacggtattcattgatgcttttattccggatcacccgggtgttttttggaatagaaactaagtttccgtcccggatgaaaatacagccgggattatcaaattccaccagataggcttctccgtcatgaaaaacctggaggatgctgaaggtggaataggccacctgacgcacctgacacaccggaagagtctctacaatggtttccacacactcttccagggtcgcgccgtttaaaaacatggtcccaagaatcttggaagtcatggttgccagaatgttggcctttaccccgctgcccatgccgtcagccaggatcatgatgttggaatcctcggtctgtaaaacctccaccttatccccgcacagcacttctctgaatttattcaggcttttatatgcaacatctacggtaactcccatcacttgacctcactttcacttccctcatccaataaggacttacaaagctttgtcagcgtggtcttggtctccgcagttgtttcccctaaaagacctgcaatttcctgggctaccatcatctgcttgtgaatgaccttctgagccagatcaatggtttccagcttcttttcgtactcctgtcttgcctgttcttcctctttggtgatgtctatgaaggtggccaataccacatcttccttttcaatgtataaaatattctggagagtggaaatacggtattctccataagtcaccttttttccatggatcttctgatgggtttgataaacccactggaaatcagaaggatcaatgagttcatataaatacatggtcaaggcttcctgtctggtttttccgaaataccgttctcctactgcagaatactctaaaattttcatatctttatcaacaattaaaacaatattcggagaggtctccatgaccaggttggataaggattccgccttttcatgcataaagggaatgcacatgttaagctctgcctttttctggaaaaccgctatagccttttccctgcatgtagaatagccgcaggcgccgcagtttaactcatcctcaggcctgatctttccggtcatcttcagtatctgctggatctgggcttccgttggcaggacctccctgggtgaccggtctaagaaccgctttccaaaggaaatgcgctccataacagggtccagttcttcccatggcacaggttcctttgcaatggtttcctccatatcaagcttgatcttaaatctggagacgctttcatcatcaaccgtaggccctttgatacagcctccggaacacatattcatctcaataaagcagcccttaatccctccccgcaccatgctttcgcacagatccatgcagttaaggcagccatggacataaaacttccggtatccatcccgttcctcttccgtggccagaacagaattcaccactccgttggtgaccggataaaggcggttgacccttggattcctgttggtgaaggggatatcctcgcagtcttcaatggtgatctcctcttcagagagccatctgttaatatcattgaaattcaggacagcatcaatatagccatcatggcgtgggtccgttgcttcctttttctttgcaatacagggcccaaggaaaaccacttttacttcaggccccatttcttcttttatcatctttccatgggcaatcataggagataccacaggagccatatgaggaatcagctggggataataaatctcgatcagatcgttgacgctgggacagcaggtggtgatgatgttctccatctccccctcctttaaaagccttgcatattccgcggtcacaacggccgctccctcagaggtctcccttacgtcggcaaaacccagcttcctaagggccccgtttacctggccgatggactggtagcttaacaagcccatataagacggggcaagggaaatgactgtggggatccctgcgtcaatatagctctttaccagttccaaatcacttatgagagtttttgccgactggggacagacctgcatgcattttccgcataaaatgcacttatcgggcatgatctcagcacgctcatccttaatcatgacagccttgacttcacagttacggatacatttatagcagtgcttgcattttgtagccttgaaatcaatgattcccatgattacagcctccccatgatctctttgtcaaaaaactcctttgtttcttccggttttaaggagtataattgaccttccacggttacacagacgccatttacacagtcgccgcagcaaaaggaaccgtttaaatccacctgatcttccagatgtttttccttcacaagggtctgcagctgggctatgatttctctggaaccttttagatggcatgcgctccctatacatatcgttactctcatgaatattctccctccaaatttcctaccttgcttttgattgcccttttgaaacattatcgcatattgatatatttttatcaatatttttttactgatttcctgtactttttcaggtacaggaaataattgtctccacgatctcctgcttctctacatcaatgaggccatatgtatttaaccgcagctttggaatcaccggaaggctggcaaaggcaagagtcataaagggatcaatgctgtctccgattccaaggtctcgtgtctgggctttcagctcctccagcttttcatccacccattccgccggttcttcactcataaggcctgcaatgggaagaggcagttctcccaaaattttcccgtcagccaccaccgctaagccgccccggttctttctcaccgtattggcagcaagggccatatcctggtcacaggcgcccgccacaataagattatgggaatcatgagcaatactggtagcaactgccccccgttttaagccgtatccgcctaagaagccaagccccatgtggccggtgttgtgatgccgttccagtaccgccattttcacgatatcctgctctatgtttacacctggggcaactccctggttttccgtccatggagccagaagctctttggtggtcagctctcccggcgtaaggcaaagtacccggatggtgctgccctttttttccattcggaagtcttccggacggatctcgtttaaatggaaggaatctcccacccgggcaggggtctccacgctccgttgttccgccgcaaggattccctctttcattacgccgttttctgccaccagctttccgtttttatatacctgctttactttaaagtccttcagatcggaaacaacgatgaaattcgccttgtatcccggcgcaatggctcccacctcacgaagtccgaaataactggcgggatggaaggaggccatcatgacagcatgaaccggatccgctcccagacttatggcctctcttatgatatagtccaaatgccccagccggatcaaatcacctggatgcttatcgtcggtgaccagcatgcagcggtgataatacggctcctggaacaggggcatcagagctcttaagttcctggctgccgttccttcccgtatcatgacccactgacctctcttaagcttttccactgcctctcctgcatcagagcattcatgatccgactgcacccccgcggtcacataagcattcagctccctgccggaaagccccggggcgtggccgtcgatcagcagattcctgttcctggcctcttccaccttatcaaggatcccccggtccgcccttacagttccataagagttcataagctcggcaaggccaagcacccgttcttcctcatagagaggggaaagtgcttccgcagacagcactgcccctgattcatcaagtcccgtggccggtacgcaggagggaagcatgaaatacacgtcaagggtaagccccctggtccgctccatcataaaacggataccttccgctcccgccacattggcgatctcgtgaggatccgtaatgaccgcctgggtcccatgaggcaccacagagcgctcaaattctcctggtgctaccatggagctttccagatgaatatgtccgtcaatcagcccaggacaaaccaccgctccccccagctcgatctccgtctgtccctcatagtcccccactcccacaatgtaaccatcctcaacagcaatatctccatcttccagttctgccgtaaaaacattgaccaccttggcatgttttaacaccatggacgcttttttcgcccctgatgcagccagaatccgttctgctaacatccgatccataagaaaatttctcctccttttatttgcctgcgatctttgtaatggaagccgtaatcagctttttaaacaaaggtgccacccggtctgccgtctcctgcacctctccatggcttaaaggctggtccgtaatgccgcaggccatattggtgatacaggaaatgccgcaaaccttcatccccatgtggtttgctgccagcgcctcacaggctgtactcattcccaccgcatctgccccagaatgcggcacatctgtacctctgccggagactcgtatgcagggccggtaagctgcatgtaaacaccctctcttaagccgatcccttcttcctttgcagcctctttgatgacctgctgcagctttttgctgtacacatcgctcatatccggaaatcttggacctaagtcctctaaattttcaccgattaacggagacggaacaaagctggcaatgtgatcccttataagcatgaaatctcccgcctgaaactccttgttgacgccgccgcaggcattggtcagaaacagcacctttgctcctaaaaggcccataagcctggccggaagcaccacatccgtcattggatatccctcataaaaatgaacccgtccctgcataataaccaccggaacctcatttacatacccgaatacaaatcttcctttatggcctgcaaccgttgatatggggaatccttcgatatctttatactcaatggaggtctccacctttatttcctccgcatattccccaaggccggaccctaggatcaaagccacttccgggacaaaatccgtcttctcccgcacactcttcaaacaattttcaagctttgcatatacttcattcatacgcctttttctcctttcattttaccgtccacgctttttggacatacagatatgcccgtaggatgcttcacattcctgtcagacttggccgacataagtacatacagtatatcacattttcagatttatctgtatctatattttgacaaagataggggaataatggtatactgaaggtgttcgtactaacccggaaggaaccctgacggagaaggcgaggagaatacgtaaatcggaaatcccatgcctgttggtatgggtttttttgacggtaaaaaagccatgacaggtacggacagaaagcgaggatcattatgaaaaaagcagtatcagtattgatggcgtttgccatgacagctgcccttctctccggctgtgcaaagagcagtccggaaagcacccaggcgacctctgcctccgaaaaggaatccaccactgaggcagcaaaggaaacgccggaaactcaaagcaccggcgatacctataccttaaaaatcggctccttaaaagggcctacctccatgggacttgtaaggctggcggaccagtctgaaaagggcagcgcaaaaggctcctatgaattcaccatggtaaccgctgccgatgaactccttggaaaaatcgtaagcggagagcttgatgttgcacttgttcccgccaacatggcctccattatttacaataagagcaatcatggggtgagcgtcattgatatcaacaccctgggcgttctctatggaatatctgccgatgattccattaagacggcagcagacttaaagggaaaaaccgtctacttaaccggcaagggaaccacaccggactatgtccttcagcatgtgcttaaggccagcggcttaaccacggacgatgtgaccctggaatataaatctgaacctgctgaggtggcttccgtcctgaaggaaaagtctgacgcagtaggccttcttccccagccatttgtaacagccgccatggctcagaatgactcccttaaaatggttcttgacttaacaaaggaatgggatgccactgccggcgaagacggaggcagcctggtaaccggagttaccatctgccggaatgagaccctaaaagaccataaggatgccattgatacttttatgacagagcataaggaatccgctgagtttgccaatgccaatgtagcagagaccgctgctttagtggcagccgccggaatcattgaaaaagcccctgttgcagaaaaggccatcccatactgcagcatcacctatgtggacggaaaccagatgaaatccctcttaagcggatacttaaaggttcttttcgatatggagccgacttccgtaggcggtacgctgccggccgatgatttctactacatgccataatttgcggaaaacccggtaaggagattgacacaatgaaaccaacagcccgatcgcttaaaaaggccggaatcatccttttctggcttctggcatggcaggcggcaagcctggccgtgcataacagcattatactggttggccctttggaggtgatccggtctttatggatccaggcagccatgcccggtttctggaaaaccattgccctctcttttggaaagataagctttggatttctcctggcttttgggacaggaatcttaacagggggcgctgcctgccgttttcctcttataaaagactttctggaaccgctcatgtccctgatcaagtcggttccggtagcttcctttgtcattctggccctgatctgggtaggctctgaaaatctgtccgtttttatcgcctttctcgtggtattccccatcatctacataaataccatggcaggctttatgagtacggacccaaagcttctggaaatggcccgggttttccatatgcagggaggaaagaagctcttttatatctatcgacctgcccttctcccatacctcataagcggctgcagggttgccttaggtatgggctggaaatccggcgttgccgcagaggtgatcggtgttcccagctattccatcggtgaaaagctctatatggccaaaatttatttaagcaccgcagatctttttgcctggactctggtcatcatcgcaatcagcgccatttttgaaaaattctttttatggctgttaagcctggcagaggccggcagaaagtttcataaaaaaaggaggctcggcccatggaagtaaaggtgaatcatctgagtaaatcatttggtacccttaacattttcacccaggtaaatctctcccttcactccggccgtatttactgtcttatggggccatccggatccggaaaaaccacattcctccggatccttctgggccttgagcaggccgactccggttccatggaaggtcttcatggcataaggtcttccgccgtgttccaggaaaaccgcctgtgtgaaccatttaccccggttgacaacatcgtcatggtgatcccaggccgtacttcccgaagcaggaaacaggccagggaggagctttcacggcttcttcctgaggaagccttatcccgtcccgtatccacactaagcggcggaatgaaacgccgggtcgccattgtaagggcattatcggttccttgtgacatgattataatggacgaaccttttaccggacttgatgaaaacacaaaattatccgtgatccggtacatcaaggaaaagacccgtgacaagctggtcatcataagcacccaccaggaggaggatgttgcactccttggcggaacactcatgacattgtaaaaacaggggctaaagcaggaattcccgctttagcccctgttttctattatacatcttaatttcctgtcttatttcagcttcaatgtatccagagctgcctcgatctgaccttctaccgcggtatccggtgattccactgttcctgctgcgctgatatactttttcgcagcagcgtcataggaaccggagatcgcataataacggactccatcctgaggatccttataccggatcgcataacggaaggtctggcttccgtcactgccgttttctacattataacggacaaattccatatcctcgccacggctgattaattccttgtactcttccatggtatccggatagatttctctcgctccgtctgcatcttctccttctgcataagtaacttccagcatatcgctgccgttgggagaggtgaatgcaactgcgctctcatctccatcatcttcaatggtccagccttgcggcggcgtgatctgatattttccggatttggaagtaaaaacaccggaagacaggcttcctgcatcagaagcggccttctgagcggcttccgtcccagcatcagcctcattctcggaatcctcttcacttcccgcagcatcctctgagctttttgtttcatctgccgttccttttgtcgtttccgcggtaccggcctctgtagaaacatcctgcgaggatttggaattatcttttgatccacaggccgtagccgccatcatgactgccatggcgatagcaattattgccagcatcttgttttttctcattttaatcactcctcatcatgaatttcattcctggtgacgatgaggattataacattatctgcatcaaatgtataggggattaaaggaactgaaagaatcaccaaaaattcttaataattttacagaagagcttccgcgcgctccagctccagcaattttacttttatatccaggcctccgccgtatcctatcaggctcccattggccccgatcacccggtggcagggaatgataattggtatgggattgcggttatttgccatgcccaccgcccggcagcctttgggattatcaaccatgaccgcaatatctttatagcttttcgtctctccatagggaatcagtaacagggcattccaaacccttttctgaaattccgttcccgccggctttaatggaagatcaaacacggttctcgtcccagccagatattcttccaattggtcttctgctctcccgatcagctctgtccgctcctttatggcattctcaggctctgaccttccaaaatctatgcttagaaccgcttcatcatcacatgtaatggtaagaggccctattttgctttcataaacttcccagtacttcattccaaatcccttctttctcttatggcttgtacgacaatagacgcttgcgtttattatatcataaggaagccaaagaaacgactctttccttatttattattccaggacaggggtgcaggaagcaaactatctgttttttcaaacattcctcataattcttttagtttttttatgaaatgtttatggcttagtcaaacttccgtcatattttccgcgtatacttattattgaaaaggaaccccacccttttaacattgactttttatttttcatactcaaccggcaggaacatgatatgtacctgccggttcctcccatttcagggacatttttccacagaaaaaacgtacatacaggcttaaaaatgaatttgaaaatttttctaaaatattgttgacaaaaacatatccatcatatataataactcttgcgttgcggaaaagcaaccaagggaaagatggaaaatgctttcacaatcggggtgtggctcagtttggctagagtacctggtttgggaccaggggtcgcaggttcaaatcctgtcaccccgatttaagagaaaagccgttaatggcagttttagcttctcttgccttttgcgggtgtagttcaatggtagaacaccagccttccaagctggatacgtgggttcgattcccatcacccgcttttgagtctgtagctcagttggatagagcaacggccttctaagccgtgggtcgggggttcgaatcccttcaggctcgtttcacatctctgaccaaggtgtgaaaaattatggtgggtatggcgaagttggttatcgcgccagattgtggctctggaggcccagggttcgaatccctgtactcacctttcccttttagggaatttttttttatcaccacttgttattgggctatcgccaagcggtaaggcacaggactttgactcctgcactcgttggttcgaatccaactagcccagtatgggatactagctcaggtggtagagcacttgacttttaatcaagttgtccggggttcgagtccccggtgtctcatgaacaaatcaggcaagccgggaaagtaactctttcccggctcctttttttacccgcaagctatatattgaaggaatcctacgtcctgccccacatagaacctcatgagaacccagtctttccctattttccttgacccgcttatttttcatgcaattcatttattatcaaccgatcttactatcaaatatggcgtttgtaatttgcaccgaaagctgctctcttatctcttgtttcacgcatttatatgttataaatccttccggcatgaaacgtcttatatgccccttctgatgcatgaagtgcggaccatggcatttccccgcaccacattgatacaggcccggtatgggcattttaaaggcctctgacgagcgctttctcttctatatttataggatctcatatttcttccgaatcatcagcccttaagacttaaacaggaaaagcatcagccacaaaaagtaataagatgattgtttatctgcccttaaaaaactataatagattcataggattctctttactttactctcctctctaatttgtacataaaaagagaggacaggcaaacaaataaaaaatataatataaatgaaagggttgattttatggaatggattgagggattaaacaagtcgattaactatattgaagaacacttaacggaagatatagactatgagcaagtggggaaaatagcctgctgttctgtttatcattttcagagaatgttcgcatatatggccaatgtacctttatctgaatatgtacggcgcaggcgcatgtccctggcggcagtggaccttcagaacggggttaataaaatcattgatgttgctctaaaatacggttatcaatctccgactgcattcaaccgggcatttcaaagtgtacatggaatagcaccgtctcgtgtaaaagaaagcggcgtttccgtaaaatcatatccacccatcagtttcaaaatcacaataaaaggagtggaagaattgaattatcgaattgaaaagaaggaatcattccgaattgcaggcactgcacagcccctgcaccgggaaatcgaaaagaactttgaaattgtacctcaaatgtggagcaaggccgctatggacgggacaattccaaaattagcagctatggcagacggatgccccgtgggaatattgggagtcagcatatgcaatgattcagaagaatggaggtactttattgccgcagccagcacaaaagaaattgatgatactttggaggaatataccattcctgctttcacctgggccatattttccggagaaggccaatgcccccaggcaatacaggaactggagaaacgaattgtcactgaatggcttccctcttccggatacgaatacgacaatggaccggatatagaggtttatttaagccctgaccctcaaaatgcaaagttcgaagtgtggatacctgttattaaaaaataagcaggaggacatcttgaagggatcaaaagaaaactttacagcttttctccaaacagcagacaatggttataaagattttgttgtaataataaatgattatctcgcacaaaacaactgcaaatgtgaaattaaaacgagttgaactcaaaagaacccagcgtgacagcggccgaccattcagcagcttacacttctatgaaagaagttcccaaaaagcaggctctgattaaaatggccgctgatttcacgccattgtgccgcactctcctttattttcattgcttaccggagttttataagcctccagattgtcacacatttttattaatactttacagaatatgtctatttcatcttcaggtatgccggagcagatgagttcttcaaactgctggaaaacctttcttgtctcttcagcttctgccagcccttttctgtgagactgatcagaaaggaacgtctgcagtccggattgttttccctcagaaggaaccccatatcctgaagtttgtctatatttcttgacatggtggccgcatcgaaacggcatcggtctgccagctctttttgagtgatatggtccttttgtaaaagattatataagatcctggcgtgcccctgcccaggcgtcaatccgatatttgacaaaagcggagaaatcatctgcttcctggccttttcttcacgaaccaacagctctctcacatcatgttgcttcatatattttcacgttcctttcacttcgctcaaggcaaagacaaatgataaaacatgttgtgcccttctgctctttgttttatgattcctgtatagcataacaagttcctgcaatacatgggttttaaaatcccccagttaaaaccgtatgaaaaacagccatatctttcctcttcatctcatcattctaactcaaactgccctgtatgcaattggtaatatttccccttttcctgcagcagttcttcatggctgccccgctcaatgatctctcctttttcaagaaccaggatagcgtctgagtttcttacggtggacagtctatgggcgatgacaaataccgttctgtctttcattagggcatccatgcctttttcaatgagcttttccgttcgtgtatcaatagaactggtagcttcgtccatgacaaggacaggcggctgcgatatggcagccctggcaatggcgatcagctgccgctgaccctgtgataaattgcttccgtcactttccaacagggtatcatagccatttggaagacgtctgataaaggaatccgcatttgcaatttttgcagcggccagtatgtcttcctgagaagcattcagccttccataccggatattatgggcaatgcttccggtaaataagtgggtttcctgaataaccagagagatggaacgccttaaatcatccttttttatgttccggatatcgatcccatcgtaggttatggtgccttcatttaattcataaaaccggttgaccagattgataatggtcgtctttcccgcaccggtagaaccaacaaatgcaattttctgaccaggctttgcatacaggctgatgccgtttaaaatggtgtttccgcctgtataaccgaaaaccacatcatggaaccggacatctccctttaaggggaccagaagatatcccatatcccggtcaggaaccttccaggcaaaggaaccggtatagatatcagtttccttcaggcttccatcagcctcctgtatcactctctttaaggtgacggttccttcattggattcaggttcttcctccatcatattaaaaatcttttctgcactggccagagctaccatgagaaaattgatctgcatggtaaactggttcatgggcattgcgctctgcctgacataaaccagataagatgccagagttcccatattaatcagtccggaaagcgcaaacaatccgcccacacaggcagaaatggcataattaatgtaagaaagagcaacaatggtaggaacggtgatgccggtataggtggaggccattgtggaggaaattctcaatttctcgttcagctcacagaacttttttaaatcctgcttttcatggcggaaaatcttttctaccttctgcccttccaccatttcctcaacataaccattaatgtttcccagatttttctgctgctgtacaaaatactttttgctcagccttccgttgtgacgaatatatattaacataaccagaagaaaaaatacaacgataaatgacagctgccagtccaggagaattaacatgacaatggtgcctacggaagtaataaagctctgtatcagcaatgtaaagctgttgttgagcgcttctgagatggtatcaacgtcatttgtaaaatggctcatcagatccccatgcgtatgggtatcaaaaaattccaagggcagcttctgggtatggcggaacaagtcgatccttatctcactgaccacctgctgggaaacgtggaccatcattcggttatacagcagacaggatatagctcccgccagataaatcagccccattatgaaaatcattctcacaagaccaggtatatttcccggcagaatatattcatttatgaccggtttcagcaaataggttcccatgattccggaaaatgcactgatgcttaccaggatcgctatgagcagcatggagaatttgtaatgaccgatgtatctcaaaagctttaccatggccctttttgtatttttgggtcttacatgtccggtattcttcataaggactgactgcctcctttctgctgggaataatagatatcctgataaatttcattatcagccagcagctgttcatgggttccaatggcatttattcttccgtcatcaaggataatgatctgatcggcatccataatagaagaaatccgctggctgataatgatctttgtcatgccgggaagtgatttatccaggccctcttttatttttgcttccgtctcggtgtcaagtgcacttgtagaatcatctaaaataagtacctttggcgcttttaagatcgctcttgcaatgcaaagccgttgtttctgtcctccggagacattaacccctccctgccccagctccgtatcatatccatgatccaggcggccgatgaattcatcaacacgggcaatggcgcatgctctttctatttcttcatccgttgcatcttcttttccccagtaaaggttctccttcactgtgccggaaaaaagggtgtttttctgtaacaccatggcaatggaatctcttaaatgatcctgggtatattcgtatatgggatggccgtcaatagtaatgttgccggctgttacctcatagagccttggaatcagctgtaccagggtacttttggcggcgcctgtctgaccaatgattccaatggtctgtcccggaccgatttcaaaggaaatgtcggaaagcacaaattcctttgcatgctccttgtatttaaaatatacgttttcaaaccggatccgcccttccttaatggaaatatcctttgcgcggtcatcattgatggtcggttcctcctccaagacttctgaaattcttttccatgaggtcagggagcgggtaaataacagaaaaacgttggaaaacatcataagggaattgagcacctgcagcacgtagcttaaaaagctggtcagagcgcctaccttcatgttaccgatcatgaccaggtttccgccgaaccacagaatgcttaatatggtcccgtacatgacaaactgtaaagcaggcatatttaacgctgccagagaaaaagacttttcggaggaattctgtaagttcatgtttccctctttaaacttatttatctcatattctccccggacataagcctttaccacacgaatggcgatgagattctcctgaatgatcctgtttacaagatcaacggctccctgcatttttgcgtacaagggtcttacgttcttaatgattgtaaataatataacagcaagcactggagccgcaattaaaaacactacagcaagttcggcattcagcctgaaggaaacgatcaatgcagtcatcatcataaccggagaacgaaaaccgggacgcatgccgtttgtgatggaattctggattgtggtaatatcgcttgtaagccttgttaccagagaaggggtgctgaaccggtccgtgttagcaaaggaataggtctgcattttctgaaactctgccatacggatttcagccccaacaccatttccgcagatcgcggtataccgggcacatgcatggcccagaaaaagagagacaacagcaaagaataccatttggaatccctttagaaatatgtaatttttatcaccgtttgcaactcccacatcaatgatatccgccataatcatggggataactaattcaaaaatggtttcagcctcaatacagattactgcaagaataaattcttttttgtatttttgggcatagagaattaaatttttcatatcaggctcccgtattagttgttgtttcaattattgcatttacaacaattgcacacacaactattatatcgtgatttcttgaattgtcaatgaattttatggggtgccagggcaacgccccctgatctctgctcgccaaatacatttaagaggctggcagacgtaattctctaccaacctcttattcactgattttattcttttctatattattgaatcccctataggtctaataatatccgaccgggaattattggacccatacgcctgactggttaacataggaaccgtccggtgttgtggtattaacaagcatatatccatctgatcccatataataccataagccgctttccggagattgataccaggtatcctttagataggtaccatctgaattttggatccaccaaccatttccatcgcttgcccatttctgagtgactgctccgctttgagcaacagacccacttccagcatttggcgctgaccagttatctgttaaatgagcaatccatctccaggaatagttaatatcaatgtcagttacatatataacaataaagggatcatttacatgagaggtgccttgaagatcagctatcattgcctttacttcatcattatataaactatactccttaccaagctccagcctttctgtctttgctaacattccctcttcccaaaacaggcgtgtctgaccattcgaatcagaggtgctggggcaatacaggcttaaaaccaattcatgagacggatcaagatcggagccttctttttcaatgctaaaagtatcattttttggcaataccgcacatctccccgtaagctcctcgccaaactcgctcagaattaaatcctcatgccttgtggtatcctcaccgtatgtcctttctgtgccataaaacagatgaggcgaaacttcattcgctaacgctgtcattggtaaagcagacacaaacagggcagccattgtaatcaacgccgcaacattcttacttttcatactcattttcaaatcctcctggtatttttttattcaggtgtaaatataaccatatattatcatcaatggaaagattatacaacatattttgacaatataattacttattttgaaattatactcttcacacgttaaaaaaagtaactgcgaaacaaatcaagtaattattctcagaaaaacgaattgtttacataaatcaaattattagcagaccttaattatagcatccataatactttataacatataaagcataaaaggactaaatataaatacaaggtgagtatggcagctgagtttattgccgttgttctgtctgtttccgcaacattcacatatcaaaaattttttaagaaaagccaggtaaggcaaagcaaaggactatcagagcttttagcatcattttcagaaaattttatttataaactaagaatccctctcagacaatgactttgttaaggagggatttttcagatattttcattttttattagtatatttacaagctggaacatataattatactggcaggtacaaactgctggcaatcgtgtatagggtggtaggcctcgattctacatagaatggaggtgttgctcatgaagaattttgactttaaggacataatgtcttttggtatgttccttctagcactgctgacattcgtcattatgacatgtcgctaaatgcaaaagaccttccctgtactttggccagtcgggaaggtctttgctttactaattagccaaccaccctgtggcgattgcctttctttattatattatacctaatccttaaaatattacaagtaaatgtatttattttaaaatctttgtaactacttcctgtcttcagcggtctacagcctgaaagacaaaaaaagcgaaagtccttataaattaaggtttccgcaggaacatcgctacccttaaaaaaattctagtcattctaaaaaacggaaacacttgaacaagtcaccttttccttgttaatataatattccttaaataaacataatgggccttaaatcataatatttcctggactctacccacttgtccattcgttaacattactttgataccatgagggtgaaagctactgttcgttagtatttttccaacgattccctctgttagttttccggttctttggtcagatttcaatacaatttttactgttgcacctattttaacatcagctctattttgtccgttcatttttctcctcattttagcatcagttagtttataataaattgttttacatgttgaagtttattaaattacctttacgaaaaatatttccataggctgtttaaaattggggacatcaataatcaatcctcctgaatcatgataccctatttttctatagaaatgctgtgcatcttcatctacttgagttgaagtcataattaattcatatcctgctgccttcatattttcttcccaaaatttcacaagtttactgccatatcccttatgctgatactctcgttgaatataaagcattgtacaaaaagggatattgtcccaaaacagattataccttaataaaccagtagggatattattctctaacagtacatatcccattttatctctgattttcttttcaaattcactttgaggtaagtgcttatctaatttaaaccagaaatccttatcttcttcctgcacatatctaataattatcatatttttatcaccataagtttttattcatcagttttatttttttacatttttaataaccttttataaatataatgtgcagtccgtttgctaacctacatatccacgtaattcaacacatccagcggtttttccatctgtatgaagtcatgctttcgttttgaaggctgtgttgttccttcttttaaataccaagctgcttggaccgccttcatcccaagctttctagcagtttccagctcattgctgcctccatctccaacatatatacattgctctgccttcacagataaactatccatacatcttttaaaaatctcctcttctggcttttgaatcttttgttcataggaaagataaacagcttcaaaatatggaaatagtttgcttcttcggattacgtaagcttcctcagaaaagcagttacttattagtccaatgagaagcccctcttttttcaatgttgaaagcattggaataatttcagaatgtaaatgcctgaaacactcttcttttgccgctatccgtttttctacaattttctttaaaagtgattcggagtaacaatgattctctctaagaattatttccaatacttcctccagtgttaacttccctatagtacgttccagttcagtcggacgccaaagtgcctgaaatttatcttctggaattcctgcatcctctgccatctgtactccaaaatattgaggactattatagtgcgtaattaacgtttcaaacatgtcaaaaactactgctcgtatcattgtttttccttcctgcagatacctatgtatccttttcttctcttgtattctatttgctaaataaatatagcactaaactgctagcgcagtggttctcttgctttaggtaattctttccttttttacattttatcactttatttacacacggtaaacctttaaaatataatcttaaactattttaaaggaggtcatttataatgacaaatgaagaaattctacaaaaacttgaggaagaaatttatctccgcggatttagcccccatacacaagaagaatatataattcgggctaaatcattcatgctctatgccgatcgcccactagaagaacttacggaacaagacatacgtgcatttctaatctatttattgaatgttaaaaagctttccgcagctagcgtaaatggatataacagtgccctacgctttctctttggtgccatactccatcgtcatctcaatttctatgatatcccacatcacaagcatgtttatacttatcccaccgtacttaccatgcaggaagttcaaaggatcttagatgcagcggattctctccgggataaaactatgctgatgacaatctatggtgctggactccgtgtttctgaaattatcaatctaaaaacaagtgatatttatgcttcctctatgcgtattctaattcgtcagggaaaaggaaaaagggatcgttttactcttctttcaaagacaaatctagatattcttacacagtattggtatgcctataagccgaaacattctgaccattatcttttccttaatcgttctaaaaacaaaatgacaaccagagccgctggagatatttttagaaaagctctccgtcaatcaggagtccataaacccgcaacgattcacacattacggcattgttttgccacgcatcttcttgaaaatggaacagacctctgccagataaaaaatctactcggacacaccaatatcaagtccactgcccgttatctacacctaagtaactttgaagaaaaccttaccagtcctcttgataccctgtttctaaaatcggaggttcaataaatgccagaaattcaagatatcctaatcaagcacggaaaggattactgccagaatcattccatttcttacacacaacagaaggtcatgcatgccttaacgaaatgccgtacttcctgtttgggcggacatgtcactgtgtgcgacgattgcggtcatcaacaaatatcgtacaattcatgcaagaaccgccattgccccaaatgccaaaccttgactaaagaaaaatggattgatcatcagaaatataatctattaaatattgggtactttcatgtagtcatgactctcccacacacacttcatcatgttattctgcaaaatagaaaagtttgttacaacatcctattcaaagcagtttcagaaactctggctgaattatcttcagataaaaaatatcttggagcacaaaccggatttactggaatcctacacacctggggacaaaatttgatgtttcatcctcatattcattgtattgttcctggcgggggaatcaataaactcatgcaatggattccatcaaagaaaaagttctttctaccagtcaaaatagtatcaagaaaatttcgtggaaagtttctatctttattaaaacaagctttctatgatagtgcattggtatttcacggtcaaatcaagcatctggaattcctgccagaattcgagaatttcttgactcctatttacaaccaggaatgggtggtctactgcaagccgcctttcaaaacagctgcaactgttgttgaatacttaggccggtacactcatcgcgttgcaatctcgaataaccgtattctagattctaaggatggtaatgtatctttcaaatggcgtgactacaaagacaaaaacaattggaaaatcatgaccattcctgccgaagaattcatacgaagattccttttgcatgtattacctagcggtttcatgaaaatccgtcattttggaattcttggtaatcgtaataaaacaaaaaagttgaaaatttgtaagactttaaccaatacaccgatcacagaaaaaactgttttgtccaccactgaactcattgaaaaactgattggcaaaaaagcttttctttgcccttgttgcaacagtgcaaagcttaaccgatatgcttataacccaacctgacatgtttcaatttaatgattcagttatccccggttatataataatgggggaaagggggaactatgcttattttaccttataattctgtgattacaaagcaaacttttatcatttctgttttacttccatttaaatatttactttaagggcaaagtttcctattcaatccccataggttactggcaaccgcagtttcgtgctatacaattatccaaagtaatgcaccagttactggcacaattaaaagcagatatcaaagttaacggtatctgcttttttggtgcattacttcggataactatctattcataatgggaagtttattaccacctaaaaatcaatggcaaaccaggtctaaaatctcttaattgatttgactgtccattatcaaactctagctcaaggagatgttcctgactcttaataactgcaatgttctgaattttattaagaacatcagctgtactcgataatgcaatatcttgatttacaaatatttttattgatgttatttctcttaaaggtacattatgttccatcggttctttcttttcatcagaaacactatcctgcctcttagcaaaagaaagataaaaatacattggttcactcaatggtgtgttatcagctacctgaattttcagaaaatctggcagatatattggatggtaattccatacttgaaatggtaatatttcatttttatcagtagtaggtcgaaatgccatgccaaatggtgaatttacattttcttctaactcacaacgttcaaagagcctcattggtttggtgcgttcattctgcacttcttcactatcctctacccatagaagttctaacattaaattgtgaaaataaaatcttctattagctgttccttgccctggatgtgtatttgatgaaccttccaataatccgaactctactaataaatctcctgcaggggcattcttttctgtacatatataaatgtgatctatttccatgaaattcacccctttaaactttataatattgctataattagatttcaaatcaaataataaaattattttatcacactaatatttgaatatccatactgttatatgaatctattgataatttgcacaaaaaaacaaactgtaaaagaaaaagataactctttacaatttcaatgaggtcgtggagtttaccaaaacaaaccgggattgattcgttgccctagtacgaaaggcaattgatattctgaaaaagattgactgccaaagcaattttaattttatgagaaatgataaccggattacatcaaggcagatcgcctatgttttggaaaagtatgcagaacgttaggggctctccaagaagtccagatatacggtaagaaaaaccttttctagcaatcaaaacgctaataatgtacctaagctgtctacagcctgaaaacacgcaaaaatagcggaaatcctgataaatcctaggtttccgctacaaataaaaaaagcgcgagacgggactcgaacccgcgaccccgaccttggcaaggtcgtactccaccaactgagccactcgcgcttatctctttttaacttttctcttttgaggcatataccctcaaaaccacacattgttacatatctatcttcatccgttctttcctcttacctaaaccaacctggttaagccctcgacctattagtgacagtcagctgcacatgttgccatgcttccacctctgccctatctacctcgtcgtcttcaaggggtcttactcttgcgatgggatatctcatcttgaggggggcttcacgcttagatgccttcagcgtttatcccttcccgacttggctactctgccatggtgttgatcaccaacagatacaccagaggtcagtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcaatcccactttataccaccggatcactaagtcctagtttcctacctgctccacccgtcggtgtcgcagtcaagctcccttatgcctttgcactcttcgaatggtttccgtccattctgagggaacctttgagcgcctccgataccctttcggaggcgaccgccccagtcaaactccccgcctgacattgtcccccagccaggtcatggctgcaggttagaaacccaataccgcaagggtggtatcccaacatcggctctgataagactggcgtcctatcttcactgcctcccacctatcctgtacatgcagtaccgaatcccagtatcaagctggagtaaagctccatggggtctttccgtcctggcgcaggtaaccagcatcttcactggtacttcaatttcaccgggtgcattgtcgagacagcgctcaaatcattacgcctttcgtgcgggtcggaacttacccgacaaggaatttcgctaccttaggaccgttatagttacggccgccgtttactggggcttaaattcagagcttcgcgttgccgctaacccctcctcgtaaccttccagcaccgggcaggcgtcagcccatatacctcacctttcggttttgcatagacctgtgtttttgctaaacagttgcttgagcctattctctgcggcctgatttctcaggcaccccttatcccgaagttacggggtcattttgccgagttccttaacaatgcttctcccgccggccttaggattctctcctcatccacctgtgtcggtttacggtacgggcacatatcacacaatagcggcttttcttgacagcccctacgaagacttccctacttgtgttcggtacgcgtcacaccttcctgttgctgagcggattttccatctcagccagtaaaatgcttgccccggtcttttcattcccgggttcttcctcggttctgtgtccccacagttctgatgatatgcggtacaggaatttcaacctgttgtccatcgactacgtctttcgacctcgccttaggccccgacttacccagagcagatcagctttactctggaaaccttagatattcggcctggaggattctcacctccatctcgctactcattccggcattctctcttcttaacactccacatctccttacggtaatgcttctgtgcgttaagaatgctcctctaccaatgtgtatgaatacacattccacagcttcggtgtcgtgttttagccccggacattttcggcgcaggacctctcgactagtgagctattacgcactctttgaatgtgtggctgcttctaagccaacatcctagttgtctctgaaatcccacatccttttccacttaacacgcactttgggaccttagctggtggtctgggctctttcccttttgactgcccaacttatctcgtgcagtctgactcccgtacatcatctgaccggcattcggagtttgatattctttggtaagctttgacgccccctaggaaattcagtgctctacctccggcagactaatacgaggctagccctaaagctatttcgaggagaaccagctatctccgggttcgattggaatttctcccctacccacacctcatcgccacccttttcaacggatgtgcgttcggtcctccatttccttttacggaaacttcaacctggacatgggtagatcacccggtttcgggtctacctttactgactcattcgccctattaagacttggtttcccttcggctccgcaccttaagtgcttaaccttgccagtaacggtaactcgccggaccgttctacaaaaagtacgcggttccacttaaaatgtggttccacagcttgtaaacacagggtttcaggttctctttcactcccctcccggggtccttttcacctttccttcacagtactatgcgctatcggtcactaagtagtatttagccttggggggtggtcccccgaattcccacaaggtttctcgtgtctcgtggtactttggatcctgcccgctgactattgctttcccatacaaggctttcactttctatggccggtctttccaggaccgttctggtaacaaatcgtctcacttattgcagtccgtaaccccggtatgcacgcataccggtttaggctctttccatttcgctcgccgctactttggaaatcgagttttctttcttttcctccgggtacttagatgtttcagttccccgggttcccgacgtatggctatggattcaccatacgacaactgaggtttgctcagctgggtttccccattcagatatctccggatcaaaggatatttgctcctcccgaagcttttcgcagcttatcacgtctttcatcggctcttagtgccaaggcatccaccctgcgctcttattagcttaaccaattcgatgttcacctgcgggtgcgggtgactcatctaagatacatagcgttgtatctctggtcttaggtttgttatttcaccgtacgttacggttactttaacgagttttgtttggttacatcataagatgtaacacctcggatgtcttgattttgtttttatactttgacatataaaaactaatctagatatatttcaatatgtggttttcaaggtacatgcgtgatgtaatcagaagcgttattaattaaaacaaacttcgtaactacatcaaatggagatggagagattcgaactcttgaccccctgcttgcaaggcaggtgctctcccaactgagctacacccccaaaatacccggatgtgagtctaccctgtaaaggcaatctctatattcttttattatattaatcatctggttttacaaaccaatgggcttaagtggactcgaaccaccgacctcacgcttatcaggcgtgcgctctaaccagctgagctataagcccatatataatctggcacccacctgctctcccatgccgtctccagcatagtaccatcggccgcttaagtcttaaccatcgtgttcgggatgggaacgggtgtctcccctaagcgcatcggcaccagaaattttttgtcttcttggtgttctttatttaattagttattctggtccatgattgcacctccaaaacctttggttttctcggtcgcatctgcgatgcttatggagtaagccacagcctgacctccgtgaaagcaagctttcccgtactccattctgtgcctttctccgcaatcattcctcactttgcgaacataagactcaacagtatataaaacccttacttcttcttccttagaaaggaggtgatccagccgcaccttccgatacggctaccttgttacgacttcaccccagttatcagtcccgccttcggcagctccctccttgcggttgggtcactgacttcgggcgttaccaactcccatggtgtgacgggcggtgtgtacaagacccgggaacgtattcaccgcggcattctgatccgcgattactagcgattccagcttcatgtagtcgagttgcagactacaatccgaactgagacgttatttttggggtttgctccagatcactcctttgcttccctttgtttacgccattgtagcacgtgtgtagcccaaatcataaggggcatgatgatttgacgtcatccccaccttcctccaggttatccctggcagtctccccagagtgcccaacttgacttgctggctactaaggataagggttgcgctcgttgcgggacttaacccaacatctcacgacacgagctgacgacaaccatgcaccacctgtctggaatgccccgaagggaaggccccgttacggaccggtcattccgatgtcaagacttggtaaggttcttcgcgttgcttcgaattaaaccacatgctccaccgcttgtgcgggtccccgtcaattcctttgagtttcattcttgcgaacgtactccccaggtggaatacttattgcgttagcggcggcaccgaagagctttgctccccaacacctagtattcatcgtttacggcgtggactaccagggtatctaatcctgtttgctccccacgctttcgagcctcaacgtcagttacagtccagtaagccgccttcgccactggtgttcctcctaatatctacgcatttcaccgctacactaggaattccacttacctctcctgcactctagcaacacagtttccaaagcagtcccggggttgagccccgggctttcactccagacttgcatcgccgtctacgctccctttacacccagtaaatccggataacgcttgccccctacgtattaccgcggctgctggcacgtagttagccggggcttcttagtcaggtaccgtcattttcttccctgctgatagagctttacataccgaaatacttcttcactcacgcggcgtcgctggatcagggtttcccccattgtccaatattccccactgctgcctcccgtaggagtttgggccgtgtctcagtcccaatgtggccggtcaccctctcaggtcggctactgatcgtcggcttggtgggccgttacctcaccaactacctaatcagacgcgggtccatctcataccaccggagtttttcacaccgtaccatgcggcactgtgtgcttatgcggtattagcagtcgtttccaactgttatccccctgtatgaggcaggttacccacgcgttactcacccgtccgccgctcagtcaatttaaaattcatccgaaaacttcatttaaatcgcttcgctcgacttgcatgtgttaagcacgccgccagcgttcatcctgagccaggatcgaactctcaaatttaagcagatagtctttgaaagcggtcagagattggtagaaaagtctgttgaaagctcgctttcataaggacttttttgctaatctatgaacatttgcgaagcaaatggtagcgaatgaagcaaagcttcatgagcataccgcttagacctgccattcggttcaatccggggtcaaaatcaactaactagctaatttttttcccgttttacttgttgtttggttcgtatacaattgcttgtattcgttctgaattttctcattcaaagccatcaaacaatggcttgttttattagaattttcagggttttacatactgttcaatcttctgttttcaaagtgcattttgtttgttactgtcgcagcagcaacttttataggatatcatggctgtctatttctgtcaaccattttttccattttcttcaaagctttttcatcgatcatcgatgtgtttttagaagaaaatttgccgcccgttttcagcggcgagttacatcttatcaaagctggcgacaaaagtcaacaattatttcgaattattttcaataatttgttcaatttaaaaaaagcctctgatgaaacacaccaatcgcatgcaaacacaagaatcagccatggataatactcagtcgggtaaagttaaaacaaaagctgaattctaatatccacgccttttatcctgtcataaagcccttacattataatatcagaaaacaaaagaagaaactattctcctttataaaaaaagaaacacacatataaaacacgccttaaacaccccttaagacaaacggacattcacaatgaccaaggctcaagctcccctcttctactcccctccgctacttgttcacagcgtcccccgcttcaccgttcatagccgaatagcagctatcgccgcttatcaggtggatcccgcactccacctaatgtttttcgcatttaaaatagtgacttactaagtccaattaacccgaaatggtttcacaacttttttatccagtaactattttacgtaaccaaatatgttttttttaaattaagtaaccaaaaggccaactattatgttatatttatgataagatttgccgatataaaaatatagccgatttgtaattgagaaggaggtgttcctatgacgcatcttggagcaaagatcccggtatcctataatttaatgcctgacaatttgcatgacagattattttcagcaatgcatgatgtaaagagtatggcctcaaaaagaacgggcagaacgaaaaccgatatccagcgaaatagattttcatggctcggtccgggggatctgactgataaaggctcaagactaattatacctgattgtatttacataggaatgaaatgatcagaaaccggagccagcatttctttgattgggaaactgaacagagtcatatcctgacgcctgttggctacagccaaagaaaccacgggaaatcagccaattacttgcatacagggaaaaagtagcaggtattttttaatgttaggggaagaaaatgaaagaaaaaactaaaaaagggttctttggcttttttcaaaatgcaagaagttctgcggaatcttcggagaaatccgttataactgctgccgcttcgcctgaagaatccaagaatgaagatctcaaagaagcagcctccgattcaaccgaacaaaaaggctctgctgcagtaaccgcgcctcctgaaacagaacaaaaagctccctcccattcttctatatgggagcaatccgatgatccgcttatagtgcggatcgatgaagaagcattatacagtgaatgcgctcagttctccagtaaaatgaactccttgtccaatgtttttaaacggacggccgaaaacacacaggaacctgagcctcagccaaaggcagcccaggctcatctttatatctcccatgaccggatggccgcatggatttatgtgattcctccatttaatggcggtgaggggataaaggaagaagatttgaaatcccttcttaatcaagaacggataaccaaaggaattatagaggatgcgctgaaatcaatcgttgaagaacagatttatgaccagtccgtgctgattgcaaagggagttctggcacgcaacggaatcgacggttctattaaggaccattttaaacgcacccttaatcttgaatttaaggaagatgaaaacggatctgttgattataaaaaattaaataacatccaatccgtgaaggaaggggaagtgatcagcacaattacccttgctgttccgggagaaaatggcatgaccataaccggccacccctatccctgcgttattaagggaactaatgttcccataccttcaggccgcaatacctcgcttacggaagaccggactctgctgatttcccggagaacaggccatgtaacatttgccaatggaaaatttcaggtagatcccctccttaagataaacggcaatattgataatagtacaggaaatttagattatgacggggacatattcattacaggggacgtgagaaacggtttttcagtaaaggctaccggaaggattgatatccgcggctccgtagaaggtgcccagattacggcccaaggagccatcaccattgccagcggcatgtcgggaaacggccgcggcgttttaacctctgactctgacatcaaatgccgttacttagagcactgcacagtcagcgccaaaggcaatgtgtatgcggaaagcattatcaattccaaaatagaaagcggtcaggatattatcgtgacctctggtatgggcgtcattatagggggctccctactggcttccaacagcatcaatgcccgtattattggttctaaagtacggcggcttattaccgaattaataattgcaaatattccaaagaacgtggaagaatcctctcgtcttaccagggaaatggaacagctgcgccataacatgtcggaggtaagaaagaatatcacctatctagagaccacccaaagacaggataagcaactgctgctggatagcttaaagcaggcttccgcttatttaaaccttcgggaacaggagatcacaaaccgtttaaacgaaataactgcaactgacagggaacagtccggaatcattcaatgtcagcagctgcttccagtggtccgcattaaaattggctcctccagcctgctggtccaggaagagtactccagaagcattatttataaaaacaatgaaggcgaaattacgatcggaagtaattagacctaaaggaggaagctactatgaaaaaaacaattatgattgtcgatgattcaattgtaacgcgcaatgagatagaacaattactaaaaggaacaaattttgatgtaatctatcagtgcagaagcggggaagaggctttggaagcctttgagagagaaaagcccgatattgtgaccatggatatcataatgcctggaatcgatggcatcgaagcttccaaacgcctgttgaagcatcatccggaagcaggaattatcattatcagttctcttgtctatgataaaacactaacgatggtgcaggaattgggtcctctgttccctttgttttcaagccaattaaaaaatcattttttattgaagctctggtaaaagtgagtgacgcgatatctaaaaagtaaaatctgtacaaaagaaaagtcctatacataactaaatcgacatgctattcattattatattttaaaagcctaatggaaaatctgttcattcaaattttccattaggcttttcttttatacattatagattgaacctgccgttgaatcttcggaatcaaacggactggctatgcggtaggaagccatctgcatccgaagcttcatcaattcaatcaaatagagataatcggatttttccggtacaagactctcagtttccgcttcccatgactgacctgttaaatattccaaagcatttgatatgtctgatccataccctgaggtttcagaatcacccgcacccatatagttcttaaccttcttcacatactcctgcgtttctttaaagggagggattcctccatatttgctcacattgttgcttccggcattataagccgctagagtgagatccacgtttccattataccgttccaggttttctcttaaatatttagcccctcccatgatgttgctccttgcatcataaggatcatccactcctaaggatctggcagtggcaggcatcagctgcatcactccggccgctcccttctttgaagtggcagacgggttaaaattcgattccgccttggcaaccgcttttagaagtttttcggaaactccgtactttttagaagcctctgtaaatatggcttcaagattttccggcgccttaataactgattttaaaatctgtttaaaattccccttggcagatgaaactgccgtatatcctgtctgcccggcctttgcatttgcaagtgcggacagctttaactggtctatcgtcgccaaaattcaatcctcccgccaatttctgacttttacggaatccattttcctgaagcatctacccaataattgcctacatttgtactgcttgccatactgccgtctgaatttaaataataccatattcccggctggggctggatccagcctgtcagcatttcccctccggccggattcatataataccactttccgttgacaaactgccagccgatcagcatctttccatcctgagggttgagataataccatctttggcctgacaaaagccagccgatctggcggattccattcccatcaaaataataccagtcgtttaatatctgcttccagctgtttctgggcaccccgccgtcttcctgcttataggtatttcccttccaggttcctgtcgtatcgccgtcatattccataatggtgtcatcggaagttacataatccccttccttcatatactttcggtcatcggccgtatagccgattgcacggacttcatagtaataaactgcatccttatccatatattcagaaagatccacggtattggtttccacagaaatgcgctttttcagcttgtcatctgcatacagggcaacctgatatcctgtggcaaactcaaccttctcccaaacagctttcgtctttttgctgtcgctccatcctgctctcgacgtccttcccaggatcaccacagggacataatccaccttcacttccagggtattgttatccagtgctttagcagatacgaacttggctcctgtgagcttgcattccgaccggttgtaggcatttgcaaatatcatggtgtctgacgataaaattacgctgacccgttcattctttgctgccttccatttgctgatatcccgtttccatatgacttctttaaccgatactccggcagttgttgtggaaatccctggcatcagtatttcttcattcccatattggctgtcaaacttaagattcacgcttcgaatcactatggaatcgtcagcataggaatttatggctggcagacatgccagtaccgccgtaaacacagccaggaacacagaatacagtttccttcttttctctctcatcattgtacccatactccatcctcattcaccggaaatccgtcgatcaccgtattaacagccatggtgccatcctgattaaaataacgccacagtccgtcgatcttttgccagccagttaccatgactccgtcttcccccgtaaaatatgtatgtccgtcccggatgatccagcccttcagcatagctccttccaggtttgcctgtatggtatttaaataataccatcttcccgcctggttaatccagcccttctgcatagcgccctggctgttaaaatagtaataatatccgtctaagacctgccagtctgttgcagcggcgcccaggggcgcctcgtaaccgttgtccgggtaaaaataataccatgtaccgtcgattttattccacccggtcaccatagcccctttggaatccatataatagatatcagaattcaggagaaaccagccggttatcatctttccttcctggtcaaaacggtaccacacattatcaagcatcagccaggaattagcctgaaccgttccatcggcgtaccggtagaaccatactccggactgctgatcccagccctcctttacttccgtaccgcttgctgtgcccgcagttgtatcggagtcctttcctgtcccatcggatacatccctatccctgataaccagttcatcagattccacccaaccgcttttctttccgttctttaattcttcctgcttaaagggaacggaccggatcttgtaagaataggttccttcttctgtcatataaggatagaaattataggaggtggcttttacctgctccttctttaaaacaatcttttttccgcaataaagccacaattcataagcgcctgaagtattatccccttggaccagacagcctggccaagtcttgtatccttccagcccacgtcttccggttctgcgtacaggcctttgaccggttttgtccttaaggtcacaatcatatcgctgcccttgcgttttgcgctgacataagaaccacccgtgattttcatcttggaagcctcataagaggatttaaaataagcgtcatattcgtcggagggggtaagagtcacattcatccttggctcttctcctaccgtcatatcttttgatgtggaggtgacccactccgcctctctgacaatgtatcttttatcaccggaagtcacatagcactccccgctggttttgtcgatctggatatcaggcaaacgatctcctgcctcaatattaagtactactttaatgctgattgaattgatggcctctgttgccatcgctttttccgggaagagacacaggcacaaagccgcaagaatggctatagccaatcccctcttttgttgtttcatgtaatcgctccttttaataatacatctttactctgcagtttataaatttcaatgaccggatgaagaaatcactgtatctttcttcttttaagctgttccagaaaagtgaatcttctgaccatggattcctgataagacgtcatatcaaagaaacggctgccataccggtaacggggcggttcattttcatttgataattttttcacccacaggatgctgcctttgagtctggtacagccgctgtcggtttcaaacagaaaagaatagatctgcgcttcctttaattcaacagccgactcaaatccaatccctcctgcacttatatcttttacttttgcagttatatgtgtgacctttccgtctgcatctgccgtctccaaggtgacaggaaatgaaatcctgaccttaaggtcgcggcgtctttgctctacgccgatcaattcatcaatctggcatgggaccttatagatcgcatttccgatctctccgctttcgtctccgctgattttcacccttccggataaacggcatttacatgtaacaagtccttgaatgccgtcataaaatacgatcactgattctgtgttcaccttatccatatcttcctcttcaaagataagccccatactgtccatatgggaatccaccaccttcacttctgcgatgaagacaccatctaaggtataaacacatgctttttcacattcaattaacataacctactccaccgtttcctcttttattatttcctcttcctctacttcctttatatgctcctccggctccgttttttccactggcccgggcacataatccagaaaatacaggtagatatccacgattgcctgatacaattcctccggtacctggcttccaagctcaagctgggttaaaatggttgccagagaattatcctcataaaccggaacaccgctttcattggcagtttcaattattttctccgccatataccccataccggaggccacgataactggagcagaattcttcgcatcgtcatatttcaatgcgaccgcctttttatttaacgtgtttctaaattctgacatcaactgaatttttcctttcatggattttgggaaatacctctaccggcgaagaaggtccgcccctgcctggagatatatgttgtccgcccggaaatgatgccggtcaaggatatttttaatccccttatggatattggcctctgatttctgcattttttccggataatagagctgaagggaggccgcattgtccccataaaacagcagcagcttaaactggcccaattccctgatatcgaatttaacaaaaattctggccctatgctttgcccctgcctgggtgctgctgccctcctcatccggatcgatccacatctcggagaacagtttccgcccgtttacattcatgggaaatgccagatgcaagaggggcatataaacactttcatttaaaaccagggattggagcatattctgaaacatctgcttattttcaagccccgtacctccgctcacaccggttcttagaaaatcaatgaacttttccgcccattggttttttcctgctgcctgctctaaatccacctgattcagcagctcattaaactgttccattgtcatttccccgaaaaacttacgaaatccctgatagcccgtcagcctggaaaaggactgcaaaacctcttccctgttcccgttttcatatctggcgatcaataccgttaaaagagagatcttatcccgtatggtgcccatatcgtgattcactgcaatatagcggcccagaaagggaaggagcttttccttcagcagcgcattgttgtgggaggtctgtccctcaggtgcagataaatccagttccttaagcaaagcctctatctgctcccttgtctgcttaaaaacatatccctccatatcctttactgtattaaatatatcatgaagtatatgctttccggaagacatatcgttgaatttcctgataaaatttaaaacctctgcttttaaatccacagaagtcgtctctgccatcacttgacgcagctggtcaaaaatacctccgttaaaacggactgctgattcggcctgctcctttagaaagggcaggatctcctccgcctgcatctgggttgcctcaaaaaaggaagcgatcttctgtgctgcttcctctcccatgactcctcctgccaacacctcttccccctggaaaaacatatcggtaaatagcttggaaagatcaggtgtgttttttaccaggtttaaaaaggcaccgaaatttgacccgtactggaatgccagctgctgttccccgtttccgccggagtcagtccggttatcccctctcatcacctttgatgggtctacaggattttggatctgcactccctggcctgcctgggggttatttttaatcgttgaattatcataaccggaaagcggtgttgtaactttcagaatatctgccatactatgcctccatttaactggtattttacattttttttcgaaaggttatttaatttactattattttttatccaaccataccgataaatagatatatactaaactaaacaaggcggtgtaaatattatggataacggcatggaaaatatgcttgatatgtatctctttgaaaccaattcccttctggagcaattggacgaactgctgatagaagccgaaaaggctggagattttacggtggatgatgtgaacgaaatctttcgtatcatgcacaccgtcaagggctcttccgctatgatggagttcacttccctgatgcagatcgcccaccatattgaagatctattcttttttatccgtgagaatggcctggaatcccttagcgtttctcacaaaagcaccctttttgacttaatgttccgttctactgatatgcttcgtgctgaggttgcaaaagtagaaaacaatgagccacttagtgataatgtcgacaatctgactcaggaaattaatagtttcctgaaaaaaatcagtaaggataataaccagaccgaaagcaaagaaaaaagcgtaaaagctcctgaaccccaggaagtgcataagtctgctgctcccgcacccaaagcaccggctgtcaacttaaatgaaatccggctggatctggcggaatgccctgatgataaatcccctttcttcttaaggatcttctatgacgagggctgcggaatggagaatctccgtgcctttatgctcataagcaccttaaaagaatccggactggatttcaattattatccggaagatgtggaaaccaacagccagagcaccgccaccatcattgaaaagggctttttcttaacctttgattcccgcaaggatgcggatatggcaatctcacaaatcaataacttaaacaatatccgttcttatgagctcattgaaaatgtgcgcaccaaagcttctgcaacaggggaaactcagaacgctcaggcttcttctccttctgaccatgaaggaaccggagccccaaacactcctgccgcaagtgccggacaccagatgcccagcaagcagaatttaatcagcgtgaatttaacaaagctggataacctggtggctattgtaggcgagatcgtcattacggaatccatggtgacctcttctcctgagatccagaacttaaagaacttagacagctttttaaaggctaccagacagcttcgtaagctgaccgatgaccttcaggatattgtcatgtcccttcgcatggtgcccatatccggcgtgtttcagaaaatgaacaggatcgtccgggatatgaagcaaaagcttaaaaaggacgtgcgcctgaccatcatcggcgagaatacggaagtggataaatccattgtggacagcatcggtgatcctatcatgcatattgtccgcaattccatggatcacgggattgaggaaactgccgaggaacgtattgcagccggaaaaaatcctcagggagagctggtcctttccgcaagccatacgaccaacgaagtaattatctccatcagcgacgacggacgtggtgtaaaccctgcgggagttctggcaaaagcaaagaaaaacggcgttctgacaaaacctgaaagtgaatatacccataaagagatcctggccctccttcttgctcccggtttctccaccaacgaagtggttacggagttttccggacgtggtgtcggcatggatgtggtcaagaaaaatgtggagaatatcggcggcaccatcaccattaccagtgaactgggcaaaggtatgtgcactaccttaaaaatcccccttaccatggctattgtggacggtatggaaatcgcagtcggaaaatccgtctttactatccccatcgccaacatccgccagtcctttaaggtgaaaaatgacgaggtgatctacgataccgaaggcaacgagatcatccggtgcatgaaccagttctaccccattgtccgcattcacaggctttacaacattgagacggaaatcaccagcattgaggatgggatccttgtatgggtggaatccggcgacaagtcctattgcctcttcgtagatgacctactgggtgaacagcaggtggttgtaaagccccttcctgtatacttaaacagcttcaacatcaaggattcgggaatcagcggatgcaccattctgggcgacggcaacatcagcatcatattagacgttttaaatctgtatgctgcagcacataatcaatactaatttgggaattggaggaatacaaatgtcagcagagaatacacaaacagcgatgtctggtgcagataattttacaagtgaagattttatttccggcggttcagaagccatggagcgctacttaacctttcgcacagataacctgattttcggtgtaagcaccaattatatcattgagatcatcaccaaccatgccattacccccatgcctatgatgcccaactatgtaaggggaatcatcaacttaagaggtcagatcgtaccgatcattgatatccgcttaaggctgggcaaaccggctattgaatacaccaacactacctgcgtcatcgttctcaatgtggattccgtttttatcggagtcattgtggatgccgtggagcaggttctggacattgattattccagcatttccccggttcctgccaataaccgggaagaactggtaagcggcatgatatccatgccggacaatcacgtagtcctgcttctggattgtgtaactttagttaataactcataaaggacgactttttatgctaacactttcgcagcaagactttacgcggctggttcagttcgtgaaaaaaaattacgggattgatctgtcaaaaaagatgcagctgattatgggacggttgtcaaacacaatcatatcccttggatatacttcatttacggattacatagaccatatcatctcatcaaaaaatcctgcagacttagaagtcatgttaaataagcttacgacgaattacacctactttatgagggaggaagcccattttaaattcttccgggatactatactcccttatctgctaagcacgaagaaaaacaaggttttaagcatatggagcgccggatgctcttccggtgaagagccttatacaatttcaatgatcatcaaggagaccctgggggcgcaggccgccctctgggatacccgggttctggctaccgacatttcccaaaatgccttaagggctgcaaaggaagcggtatacgatgaagactccttaaaaaacctttctcttgcctggaagtccaaatattttgttaaaacctcggaacagggcgtttattccgtagcgcctgcaattaaatcaaatgtgattttccaaaccttcaatctgatggaccccattcacttccggcttaaatttgacgttattttttgcagaaacgtaatgatctattttgatcagggcacaaaggacgccttgatccagcgtttctatgatgcaaccgcaccgggaggctatcttctcattggacattcagagacaattaataaggaaaaaacgccttataagtacttaatgcccgcgacataccgaaaagaataatctgtgtaatataaaatctatttgccggcattttatcttccgcaaatggattttatattacacagatttataattaaatatcaggaatatgtaaagcattttacatctgcctgtatgcgcttttattaaccgcatagaatggagtagattatgaacgaaaaaatccgagtttttgtagtagatgattccctgctgtttcgcaaggtattgatcgataacctatcccagaatccccgtatagaagttgttggatatgccattgatgcctttgatgcagaacgaaaaataccggcattaaaacctgatgtagtcacggtggatgtggagatgccccggttaaacggcattgactttgtaaaaaagcttttgcccaaatatccggttcccgttatcctggtgtcatcccttaatttaaatgtgtttgaggccctttctgccggagccgtggattttgtcagaaagcctgatatgtcagccagtaacactgccgccacctttttaaatacattaataagcaaaatattcatcgcttccagggccaggatcagggtgcctgctgcggcggcttcctccgtgcttactcaaaagccggccggcagcggaaggcccttcagcctcaatgccaataataccattatcgccataggcgcttctacgggaggaacggaagccacacttcaggtcttaaaagatctcccccggatactccgggtattgtggtcacccagcatatgccggaaggctttacaagaatgtatgcggaccgcttaaaccacttatgtcagatgaacgtgaaagaggcgcagacaggagatgttgtggaaagaggccaggtgctcatcgccccggtgatttacagatgaaagtggtccggacaggaagccgctataccgtaaactgttattccggggaaaaggtcagcggacaccgtccctctgttgacgtgctgtttcaatccgttgccgatacggccggagcttcctccgtagggatcatcatgaccggcatggggcgtgacggggctgacgggttactcaaaatgaagaaaaagggtgccttcaccattggtcaggatgcagaaagctgtgtcgtctatggaatgcctatggttgcctataacatcggagccgttaccgtccagacttcctgttccaatatttccaatgtactgctgaaacatttatattctctttaatttaagaaattgtacgttcaaaagttaatatttttttcaaagtgacgatattataaatgtagcatagaaacaactgcattttcagctcttagaaaggagtaactccatgcgtatttcctcgaactatttcaatacgctgtacaatacatccatgatgcgacaaaatcaggatcagtccggaatcaacgcttcggaatccgtaaaaaacaattatgatgcaattaccatacgttccgcttctttagaggcaatggattccaagtttgcagccgccttaaaaaatctcctcatgaaagaagtaaagcagccctcttccggagaaaagctggacagcttaaagcaaaggatcaacgatggaacttaccaggtagatgccaataagattgctgaaaggattcttttatacaaaggagcagattcccatgaatgactttatttctgtgatcgaggatttgatccagctgtttcaggaactgatttacattgaacaatcaaagctggaagccgcggcaaagaacaggattactcatgtagaagactgcatgaacagagaacaggccgccatcttaaagctgagaggtcttgacaaaaagcgggaaacctgccaggaacagcttggctgcaaggattatacatttcagcagattctttcgaaaacatcaggagcagagcataaccaattaaagaagcttttcgactcactgacccatcatgtccgccagtttcaggagataaacgaaagcgcccgctccatgattgaaattaatcttcacatgataaataaagaaattaacaattcccaggatgtcattactacagataaagcgaagtgggagggactattatgacacgatccacattctccggttttaccatcgcccagctggcaatgagcgccagccagcgtgcccttgacgtaaccggacagaatatagcaaacattaacacagcaggttataccaagcagcaggtggatcttgtaagcctgaatttaagaggcggcgactatgtaagcacaggacctgcttccaaaatcggttacggcgttgagatcacaggaatttcccagatacgtgatccctttcttgatgtacagtttagaaatcagattgccaaggtcggcaccgccgatgctcgccagagcaccctggatcagttggcggacatttttgatgaaacggataaggatgctttaaaaaaagccctcagcgatttaagcagcagcttagaccagctgtcttctaacgcaaacaacagcgagtttgacagcatcgtgcgttccagatgccaggttctcttaaattatatccatcaaaaatcagcagatttaagcagcgtccgggaagaaaccatcagcgggctggaaaaaacagatatcgccacggtcaacggacttctttctgatctcggagaattaaatgatgctatctggaaaagccaggttctcggtaatcctgcccttgaacttcaggatcagagaaacttaaagctggatgaactggcctcctatcttcccatcagcgtctcctacaaggaagtgactatatccagtgactcaaggctcagctatccggtggtcaaattcaccggttccgacggaatggtgtacaacctcaccggaggcgagcatggagaaaattttgcctctctttccatggaacggaacaaaggcatagacggcaattacgatggaagcgtttctatttccctcatccctgccagtgattttccagccggtactgatgttactactttgaaaacagacatcactgattatcttaaggacggcacattaaaaggtcttgtggatgtgttaaataaatccggagaactggacagccccgcgaccgattacagaggaatcggctattatgaaaaatcctttgatgcctttgttcagacctttgcggagatattcaacaagctgaatacaaatacatctccttatacaggagctacctcagttcccaccaccggagtcgcaaaggaattaaccagtacgggttctgaaaaagcagaatatagtttaagctttttaaattcaacgggaaatttcttaaataaggaaaaaataacaataaacggtcaaacctatacattcggtgacggtacaggcgataccattgcaatcggatccagtcttgaaggcagtttggtgaatctgactgcccggctgaatgctgacgctgccgatatgacggtaaacggcggggttactgccggcagctgggcctatcaggccagtaccggaaagcttacgtggaccagcaatgatcctttggcagcaggtaccgaaattacaagcagcagtataaaagcagcggatggatcagctttttccctcacctacaaagcagatccccttaatgttaaaaattttgacttatttaaaacctctgacggcagcaagatctttacggcaaacaatattaaaatttcagatgactggatgaacaacaccattcatattatttcctctcatgatgaaaatgccggttcaactgccaacgacaacattattaagatgataaaatctctgaccgaagaaagagattttaaatatgaatataattatctggatagtgacggcaaaccccagaccgggtcgattacttactacaacggaaatttctctcagtgctattccaacctggaaaatatacagggtattgacagctctgccaacaaggcgatcctgacgaaccacttatctgttcttcagcagaccgccaacaataaagattccgtatcaggagtttccttagacgaagagggaatcagccttatgcagtaccaaaggtcttatacggctgctgcacgtcttatgaccacccttgatgaagttctgaacgttttgatcaacagcacaggcatagttggcagataggaggtaataaaatgagacttacgacgaatgcaattttaagaaattacaaaagcaatcttgcaaccacaataaataatttaaatctgtccagaacccatgttatgactcagcgcagttttaacagcgtggcagaggatcctgcatcagccgcccgtgcctctcagcttcaccgtaaatattataaagttcaggacaacttaagcatgctgacggatattcaatcccgccaggatgggcaggagagctccctcactcaggtatccaatatcattaagacaatcagtgaggattacaacgtgcaggccatgagcggtgacaaacagacaccggaaacaagacagacctttgcctccgccatacgtcaatatcagcagtccatggtgttaagccttaacgctacctatgaggatacctttttatttgcagggtctgacggaaagaatgttccttttgagctgtcttctgacagcaaaactcttacctaccggggaattaacgtagatgcttctcagaatacttctgattatgccagccttaccaatctgtccaatgaaaagctttacgttgacctgggcatggggctggctctcgatgaggccgaccaggtggtgccttccagcgcatttaatatctctcttcccggaataaaagccatcggatatgggaaggacaaggatggaatgagcaataacgccattgttttagctggtcagctggctgatttattggaagctgatacctttgatacagaagcttatggaaagcttatgaataaatttaaggatgtaagctcaagcataatgaacggtattactgacctgggagtcaagtcagaattcctgaccacaacaaaggaccggttggagaatgctgacatttccatacaggaacagatggaaaaagtggaaggagtcgatcctgctgctgcaattactgactatatgtggaatcaatacgcttataatgcagccttaaaagttggaaccagtatcctgtcaccgtcttttattgattttatgcgctaagcatgattggaggtgtcttatatggaaccattgcttagaataacaaccatacctcttaagtatgaactaaaaattcaaaaagccaggttagaatacaagcgctcaacagctgagcttcagctaaacagggaaaaagggagcatgtctatagaaaaccgccccattaagctgcatcttgatacttataatgcgcgtaattctgtttgtccaactactatggaaagtgtccgtcagtcggcttcttatggaagaactgccgcgtcagaggctaccgcaaactatgcagaggagggggcgcttttgttagatcccagagtttcaaacccgcttgatcagattatcagccagcgtgctcaaatgccgtcaggagattttggactgcaatttcttcctactacaggtcctgacattgaatggtcggatcctgaattaaatattaaatatcaaatggataagctaagttttgaattaaaagttgcaaacggagattttgaatttattccaggcaaggttgagctgtctatcactcaaatgcctgatgtggaaattgaatatatcggcaagccgatgtatgtccccccagcgccgctgaattcttcgaccactctccggtggacgtgcttgcttaaaatcctacactctgggaggtacctatggagatccaaacacaatattttggcactatttcctgttccgaaaaagaattaatacacttttccgatggattatttggttttactcatttgaaaaattatgttcccctagcctttcaggataacagcgacgctttgatctgccttcaatccatagaggattttagtgtgtcatttattcttatgaatccattccagctatatgctgattatactccggtcttatccgaggaggacagaaaacttttaaatgtatctcaggaggacgattctgtttcatactatgttatttgtgtcatccgtgatccaatggatgacagcactgtgaatttaaaatgcccaattgctgtaaatattgaaagtcgtgaagcaagacaggtgatcctggataacccattgtatcaatttcgacatctgatcaaagatttcgtaaaaaagggggattaggatgcttatacttcaaaggaaaaaagaacagtcactcaccattggagacaatattaccataaccgttcttgacattggaaacgattgggtaaagctggctattgatgctccaagaaatgtatcaatcctgcgaacagagttaatagaagcggcctctgcaaatcaggaggcagcctctgtttctctaagtgccggctcaatatccaaaatcaaagatttgatcaatgaacataaaaacagcggagatacctgatttacttcggtatttccgctgttttatctttcacctgttctatatcaatctctttcaaaggctgatcagccatatgttccttattcgcttcttccaaggcctgatcagctatatgttccatgtctttttgcagcttctttaacctcttattttttatccaaacatcaaagctctttaaaaagggaatggatcttatcgcataccgcccaaggcgcaggagccagaaaagcggcaggagaactcccagttttcccaatgatggataaatagtttccatatatcttttgtcaggaaacagccattttatcatttttttcaggttttccgatctcctgtccctggcatagcaatctgcaaccgtcttaatcagaggaagaaattgagaactgatctcccttccttctgcccccttggtaaagatgtaagactccatggcttcatagatttctgtgttttcaatacttgccccgctgccaaaccaacggagtataagatactcaagcttttctgcaaattcagcaatttttagcttttttaacttttcatatatatatggccaggaaaaaacttctgcatattttttgtaaaacacccaaaagtccatgatctgatttaaactgatttctccctttgcataggaatccgtcagcctgctcatgagaaagagatattgatcatcaggagtcatttcccgcacatgcttataccctttccgatatggtaaaaaggccagcaggcttttaaaatattttcgcattggcttactgaaaaacagactctggttatagcataaaaccctgatccctgggatccggtagaataagtttccccgttcctctgtctggcgttcctcaaaatccgcctcctccagcatcttcctgattaaccatccatgttttttatcaatgccgatctcaatggattctctgcagcacatttcttcaattggataacatttgacaatatcagagtatcttaaagcaaagcagttgatcttatttcgttccaaaagggccaaaacctgcttttcccctgatctcaaccggtctgtccggtgaactgcttccagatatttatcaaaaaagcgctggcgtatagcctgaggaatattttcatccagccccatgattccataataaacagcatgcgccacgttatgataatcggccagacgaaacatcttttcccaatccggctggcgcagcatctcaggagaaggcttttgattcaatattgctgacaataatgttattaaataccgctcttcatatcctttactcattcattttccatcctcaatcaaccggctatatcataccgccggcaattcaatatctatttaaccggtatgccgggcaatgaattcaaccaattgcccctgtcttctccttttaaatcatgagaaaagctgcatttcacgttttatattcgttttttcataataaacttaactttaccggatattcgtacgataactattgtagaaatgaaactaatatctttatcatagaaaaggtaaattaagtgagcagaatgtatccgatcctatttaaaactctattcttagccgttgtcccttttgccacgtttttttcaaccaacggacaaattagtggagaagctgcggctatttcttatacagcttcagagataagctcagaacctgcggcagacgaaattcctcaggaaggaaaatacgatgtcatgcttgacagtgcatgcggcccgcttacgtattataatcaggggatgccagatgggggaactttctctatggcggaagagaccctctttctacctatggctgcggccctacggtcatggccatgctgattaccagtcttaccggaaaccaggtactcccgcctgacattgccacttgggctgcacaaaacaacagctggtgccccggtgaaggttcctatcacaggttaatcattgacagcgcttccgcctatggactgaaagccacacctttgaaagattacacggttcaggggctgcagagtgctttggattccggccatctcgtcgttgccctcatgaaaaagggccattttacccagcaggggcattttataataatcacccgttcaatgggagaaggtaaatttcggatcgctgatcctaataattacaataatacaaaatttgactgggattcttctttgattttccaagaattgaattaccggtcaggaaacggggggcctttatggattatcagccttccggattccgttcactaatgattgtagtaagagtcttttcctgccaaacgggtactgatatggcggtccatctcgatcactcgtttcatcaccagctggaagctctttcctctttccacaagtttttcagccacagggctgactggcttatgggcattattcccttttaaccaatctctgacctgagctgcttttgcagaaggcagagccaatataaggcatttaatgtttctttcatgaatatctgctttatccatttcctcctggcgcattcccagaagcagttgaacggaagttctgtcatttctggataaggattccccgacctccctggtaatgcgctcaatctctataatacattgatatttgttctgcatttcctttagaatctcaatcagcattgaatcgtccatgtcatccccctatctacatatttaaaaatcaaaacggcctgggaggaatgcttcctcccctccaggccggattttttaactgtttaaccgctgtgcctccttaaaagcctcacgtaaatcgataattaagggcctgacctccttaatcacttctgaatttcttcctgcccttatccggctaaactcatacagaaaaaagtcatacatccgcctcagttcagcactgatctcataattatgattcaacgtatcctttaaataagtgacaatatccaccgcccgctgaacagactgttcaaaaagctcaaagtcttccttttccaatgcgagctctgccctagtcagccgtttaagtaattcatcataaagaagattgagcatttctcctggagtcattgtattaaccgtctgttctttataatgctggtatccgtatgatgccataatctacaccgccatttcttatgaaccgaatgagctcagccaactgctttgggaattcatttgtgaaatcaatgattccaaagtagtaaactgcttcacataacggtctgtttctgttgataattgatcctgcaagcggtctatgtaatcgttgacgctgtctatactcttctgtaggtaattggacaggatactggtaggcgcataaacggaaccagccctttcaatcaatatacccttggtagcacctgttgtggaagcatacttctcagtaattgtagtaagacgggccataacgccgcccttgtcccctgtggtagtatctgcagtcctggtaaataatttttgtaaatcttctgcattggattcaagagctgcacggaacttggtttcatcgaataccagctttccgttatctccataattggagcttgtggatatcccgaaagactccagcatggctttatcctcagaaccactttcaaaaatgaaacgcatgctgtctgaaaggcctctcaaatcagaatcattgaacagcattcctgcctttgccttttcttcccatttagtgatctgatcttccgtcatttcctctttctgctcatctgtcagaggttcataactcctgtttggttttgtggtgacctcatcatttactaatttgatgatttcattgtagtctttgatcatatcggaaatggcggatacgattttgtcagagtctgttttggcattgaacgtgacagaatccgtagtatcctgagaatagaaaccaccggaggcctttacaagcgttccattctctgccattacatactctccgccagtaacttcatttccatctttatcataacgctttgcaatatcatcgacctttaaataacttccgtcatcagcctttacataagatccgtttgtgtcgtcttttttatatccaaaagtaccgcttacagtaatgtttaatccatccaggccaaaggagttgctgcctcgtatcaggtcaacaacctcatcggagccagtgtattttacactgacaactgcatcctgacccttggtaacggtataatctacatctttttctccaaacaaaagctctgcatcactgcttccgctaaaatctatacttccggcagctccgcctgctgtagatataatggaaaacttgtctgcattcatcatatagctcatggtaacgcccgcatcggaagcattaaccttgctgataatatcattaatagtgctgttgtaggaaagtcccttaatatcgacgccattaattgtaagcttcagctctctgtcgcttacataagttcccatggctgtcttcaagtccccggccgttgcagccccctcttcctcaaaatgatcgatcgcttcatagacactgcttaagaccgtatccgataactgggaataatttgatgaaatcaaattctttaacgtagcagcatccattccatctgtgactttgcttccaagattatcgatcaactccaaggcctttactgatcccgaaaaataagtggtttcataatcatctaatttagatccaagtttatctgcaattccatttaatccggaatttataagagaagctgaaagattcagacgattcgactccccatactccactttcaaagctcccgtcttgccgatcactccattgtcagcggaggatatggacaatatagaggagttgtcagccgtattggtagccggattcatggtctcaaatttcaattgataaccaccgttcttggtgtcctcctgaactcctaccttgattctgcctgttccgaacgccttgcccagctttgtttctaaatcagcagcaatggattctaaggatgctttatcatcactgcctatcattgcctgaatctcctctgtactggcaaattgtatggatttggtggttccattgtaagtaaagctgatgttctttccacctacccgctctgcaaaagacttctcttcaaaaaaggactgcgtcctgcccagcagttccgatgacagtccttcggaagtgatggttttatccgcttcagatagactgtcaatattattaataccaagagctgcaagcgccgttttacttccccctgcaagcttaatggtattccctgctttatcagcagatttgaaattcagtttaaaaggagtacctgaaggatccccggaatttgacggatcagcttcaactttaataacatctgccaatgtctttccatctccaatagaaacattcttaagagccttggtgatggattcctgcgctttcgcgccattggaataatcgtaggtaaagccatcttttgtcgtaccgctgcttaaggaaacagtatacgtcttgctgccatattgaaaagaaagactctgtccctccaaggtgctgacatcctctgttcccaaattaatactgcctgttgtcagcaactgatcggatactgctcctgtggaagacatactggcatcctttgccagctgcttcacccccacgatggacatggaatctgcaagggatgagcttcctgatacgctgatatacttgctgttgtccccaattgccgtaatactgctctttgcccaaaagctggggctggaaatattggttgactgattgacataggaggtatacttttgtgaaaattccacaagcttggagctgatggagcgataagcctcctgcttccataagtaagtttgtttttgtttctgctgctttgcaatcttagctcttgtagccgtagtcattccctcgatcaggctgtccctgtccaggccgctgacaagaccgccgtagccccggatagaagaaacactgctgacgctgcttgaaatcgatgccatatagaactcctttctaaatatgtacacaagccaattttcgtcaaaaatcggtttttttattgttttcgctatacttatttatcgacatattgtatacttaagataatagtattatcttaatttatgaatggaggaaacgaagttgtcaactgtaattgctattacaaatcaaaagggcggcgtaggcaaaacaaccacttcctgctctcttgcctgcggtctggccatgcatcataaaagagtcctggcagtagatttggatccgcagggtaacttaggcttcagccttggccttgaaatcgaatcctgcgccaccatatacgaagtcctcaaaggaaccgctaccctgcaggaggcaatccggtcttcaaaatactgtgatgtaatatcttccaacattctcttaagcggagctgaactggaattttcaggaaagcagagggaatgcatgctgaaaaacatactctctaccgtggccggttattatgattacattattattgatactcctcctgcgctgaacattctgaccgtcaatgcctatgcggcggcagactatctgatcattcccatggttccggagattttaagcctgttaggggtttcccagatcaaggagacgatcaatacagtccgttcctccgtcaacccggacctggttgttttgggaatcctgcttaataaatataacccaagaacacttctttccagagaagtaaaagagatggcacaaaatattgcggttcagatcggcaccaccgtattcgacactcatatccggtccagtgtttccgttgcggaagcacctgctcaaggagaaagccttctggattatgcgccccgatctaatcctgccttggactataaagcactggttgctgaggtcctggatcggattaaacagcgcaagaattaacaccttgagaggagcttaagcaatggcaagaaaaagcagtaaaacggcccatgtcatgaatctgttggccggcgatgattccgaatcctcaaaaacagaagcggcaaaggaaaatattgccgccagcctcacagcagaaccgggcggaactattaaggaattgacagttttggcccagcaggcctctatccaaacccaggacggaccattgactccatcccccatttccattatcgatatgtcatccacagcacctgaccctgttgcagaattaataagacatcagctggaggaggaggaaaacagcggggaagattcatcgctttccatacaggagatgccggacgatccgccttctccttcctcaaaagaagaagatttaaatgcagaagactctcccttagaggagactcagctccagaatgaaagaccttctgacgaagctcttttatctgaatcgcccgtttccaagcccttagactataagtacttgaatgtcatggaatatgtggtaaaaagcaaggcaaaggaatatatggagaaattcggtgtatgcctgtgcgaccattgcatcgctgacgtaacagccctggccctgaccaaccttccgcccaaatatattgttgtggaaccaccttccgcatctccgcttttgaacttttattccaaccgtttttcccagcatatcattgtggaactgacaaaggcctgttccgttgtaaaagaaaacccacaccattaggcgtgggttttttcttattagttctccgattcctgagatgcactgcttgtaagacctttccatatctcatttacggcttccacacaatccatatatgtttgtgccagcaggccggaaggtatacctaattgatctgctaaagctttcacattcttccattccgctttttcataactcagaatgagtttgtagagagttccgcaaattccctcctgcctgataagcgcatcctttatttcctgggccaccggcacttcctccagtatttcctctaaaggagcatcaatcatatactgcagagtagagaacattcccatcatatagatctcagaccggatgatcggaaggccctgtacatgatcggaaagagccatggcaaaattggcccgcaggaaggacaccttcatggtggcctccagggattcatcattgtcaaaatcattattaaagcttaagagatatacccactgctttaactggctgattcccatggttaccaacgcctgacgtatggaagatactctccggcgcaaagcaaagtaagcggaattgacaattttaagaagagcataggtcaatgctgcatcacgctttatgatttcttctatctgctcaatatccggctcatcctttgatacttcaacaaccagctggaagaagttcccttccaggaattccatacggttcacctttttcgccattgcctcggctacatagctgccttccgcaaagtcagctccaatttccagagccagatcataatcttcctttgtgttgaccccggttgcaacgcatctcttatcaaagcccttcatggtattgataagattcatcagcgaaatccgctcttttgcattatttttatttctgatatcaatctttatgtaagtggcaaaatccagcatggaaaaatatttgggagaaaactgaaaatcattaatggcaaaaacatagccttctgccctgtatttcctgatgatggtaggtgacaagggatggatcatcacatggtcttcaatttgaattaccattttctccttgtcaaaaatctttggcgtattacgaaacagcaaggaaggagtaaatgttacaaaagtgagcttatcacgaaaaatactttccgtattttgcatcagaaaaccagcaatggtatcagccgctgcgacatcggagctgctgtatagcgagtcataatctttctgaaacaatatctcatagccgataatcctgtcctccttcagtgcctttatgggctgccgggtgacatacttatccattcttttccctcctttgaagcaaatgatcgattacttcaaccaaatggccgatctccggtttgcttaactgttcgtcagctcctaactgctttcctttgatcattaattcctgattgatcatggaagagaaaatgaccagaggtatatgctttaagttcttatcttcctttaccagcttggtcaggcgatgcccatccatttccggcatttcaatgtccgtaatgatcaggcctaccttcttatttaaatctgaatcggaccggaccttaaccaggaaatcccacgcctcctgaccgttatttttaaaggtcagattattatagccggctttcttaagagccgcttctatcatctttgtcagaaggatggaatcctctgcaatgagaatcgggcagtcaatggtctctctttgccccagcttgttgatttcatctaactggatcccggtttccggcgcaatgtccgccacgatcttttcaaagtccagaatggtaactaaatcagaaccgcactgcgcaattcctgttgccacgccttcctccccccggcttatagtatcatccggcttctgtatgttcttccatgagatacggctgattccaacgacgctgtgaacccggaacgcaatgtgcagcttgttaaaattcgtgataatgaataagtccttgctctgtttttccgttgcttttccggtcaggtactgaggaaggtcaatcacagtaagaaggatatctctcggcttaaagataccttctacagaaggatgggcatgaggaatgggcttcaccttatctgacatcataatttcacgtactttggcaacattaattccatacaattcaccataaatggtaaattccattatttctatctcattggttcctgactctaataaaatatctgtttctgccatagctcttctcctttatcccaatataatccagcaaaaacatctgcctaataaaatatcggcatcctttagccggttcataatgtttacaaaacaatttccgctctgccataagtccgaattttcaccataccggtgctcacatcaaaggtcatggtccgtgcataattttctcccacatccgcagcagcaagccggactccctctgagtgaagaatctgtttcacactgacaatattacgggcaccgatattcccaagcgtgctgtttccctgcaattcgaacattttggcccccccggcaattttagcgatcagtctgggtttcctggctcccattatttcaatttttcgaaacgtttctgcaagtcctgtatctgcatacttaaatatattgccgtctcccgctccaaatacctcgggcagcataatatgcacaagggctcccagcttgatcatgggatcatacagactgattccgatacaggaaccaagtgcataagtaatcagaataccctcttgccttgcaaacttcatgtctgcaattccaaccgttaattgtttatccattggctatccccagcttttccattaaaaagttcaatgactgtatatccggcatcatcagcaagtcactgtgaagaactttcccccctataacaaattggccgctgatcatcatcatcttatctgtctgataaccaaattccaccattggcacgcttaaaattccgcccagcatattaacggcgatatcaggaactgataaattgatcgtaacgtcgctaagggaggacatggcattcacataagaagagatgatgatatttccgatctcctccaacgctgaggtttccaaaacattcagctggtaataatcttcaatattctgctgcatgacactggttaagacttcattgataaaatccagcttcaggataaacagcatcaatccattaatctcaccggtcatcttgaccagaatagcagctacaatttcttccggatctcccagatatttaatggcttcattatagcccaggatcttcacatccggaagtgtcatacgaacagttttccctaacaaggaggacagcgcagtggccgcatttcctgtgcctatgctgccgatttccctgatgagatccaggcccagactattcatttcatcgtaacgcgttattttcatgatatcgccctctttcctcattactcacgggatttaccgcagagaatttattgtcgactcaacctcatcagaagtctgcaccattttaagcgcataggaatatgctctctgcgcctcgatcaatctggtcatctcctgggcaaaatccactccagactcctctaaggctccctttattaccttggctttttcaagcagaatcggttctccgctttttgcggttaccgtgtagacattatctccctgactctctatgccgtcccttcttgcaaaggtatacacccctattgcccggggatcatgctctccttcctccaattccgtctcttcctcttcttcctcagtctcatctcccggatatgtggcaggctttacgtcataggagatctcttcctggtccatattaaggacccgtttgttgtctgaattcaccagatagaacttgtcctccatttgtgacagctggaagcgcccgtcacgggaataggaaacttcaccggtaacaggatcttttagcatgaaaaagccttcaccggcaatggcgtaatcgtggtcaaggccggtttccttataagccatggcagtaaaatccgtctttgactggtcaacccttgtcccgcttccggatttcgctccatcctgtccctgggcatttctaagctcagcatgcaccaaatctgaaaaaacactgtactgggctttaaagcctacagtatttacattagccacattatttgaaactatattgagctttgtctgctggcctaaagcccctaaagcacctatgtaaaatgactgttccatttatccttcctcccttatactctgcctatatcactgacaatcctgcccataagctggtcatacatcttaagcacctgcgcagcactttgggaagccctttggctgcttatcatggaagtcatctcatcaatgggatcaatattagaacgttctatcgctttccattggactcccccattggctgcagttccctccgccgtggttgtaaatgtaccgttatcacccttaacaagctgggtataatctgcaaaatccactactccgatctttcctaaaaggacaggttccgtatcctctgagtccccgccgtcttcgtcagttcccaggccctttaagggttcttcataaatatttcctaattgatcaacggtaatatgatctgaaggaagctctatggggtttccgtcttctcccagaacccttcccaaagaggataaacaaagatacccctcgtcatccagacggaaggaaccatttctcgtataaagatgatttccgtttgaatcctcaatggcaaaaaatccaggctttgtaagggcaaagtctagatttccccctgtctcctccaccgttccctggtcataagacgttttcgtggttctggcggtacgaatcatggatactgatccgatctccacaggattgcttttatcccggttgccatttctgtagagcatctcatccttaaacgtggtactgaccagcttgtctgatttatagcctggagtactgacattgaccatattgttgctgatcacatttaaattacgattctgatacagcattcctgatgccagattataaaatccatgaaacatagcattttacccctttcctgttacccatttataaaacccgtcagatacagcttcagcttttgaatcgcattagaatgaatctgtgagattctcggctcgctgacattcatgacctgtgcaatctccttcatatttaattcgtccatataatacaacgaaataaccttttgctcattttcttttaaattatttattgcatgaaccaggatctgcttaaattcttcctgcagataatgatcttctggttgttcattttcattgacagccggaagctgcaccgtttttttattgtcgtttcctgcctccagaaccatatccagggacagcacactgtagacattggttttgccaagggcttcctggtatttttccaggctgatgtccatatattccgcggtttcctttggagaaggaaaacggcccaggcggttgcacaattccataaccgcattatccagctccttggcattcttcctcacacttcttggaatccagtcctgctttcgcgccatatcaatgatcatgccgcggatcctcttggaaatgtaggtttcaaatttaacgttcatttccggatcaaatttctcaattccgctcataatggtcagcacgccttcattgacaatatcctccacctgggcaaagcttaaatatacatccctcatctgaatggaaatacttctgaccatatacatatagcgcatgaccagctcatgcttcatcttgatatcttttgtccgcttatatttaattaataaatcttcattggtatattgggtgaaatcctgttccattccgactaacaccgcctttctgacataataccctgtcaaatggtgatatttccaactgcctgaatctgaatattatttgcaatctcgttaaatgaaaggacatatacattgggatagaactgttcgatcaaacggtaaaaatacagtctgacaacctggcttgtaaggatgaccggcttttgatctaagtcgctgaatttcttgatctgatcccccagctgactgaccacagactgcattacatccggactgagggccagataaacgccctgttctccctttgccatgcttccgataatgtttttttccagctctgcatccagagtaagaaccttcatttgtcctccgtcacagaacatcctggttatggtcctctttaaggcaattctaatattctcagtaataacatccatatctctggtagttggaatcgagtctacaatggtttccagtatagtctccatatccttgatgggtacgccttcctttaaaagattgttgagaatcttctggaagctgctgtaagtaaactgatttggaaacagttcatcaaccagttctgcagaatgcttctttacgttttctaacagctgcatgacctcctgacgccctaacaattcataggcgtgctgcctgatggtttcagacaaatgagtcagcataacggaaaggggatcaatgaccgtataaccgtatatttccgccatttccttgttctcaggacggatccacttgcttgggattccataagccggttccactgtttcgatcccgtcaacttccccggaaagagtgggaggctctaatgccagataataatccaccaggatctctcctctggccacttcttcgcccctgatcttaataatatactgattggtgtttaagcttgagctgtccctcagcctgacggaaggtatgacaaatcccatgtcctgggcatattgccttctgaaaatgacgatcctgttaatcatcttgccgccgctgttttcatcaatcaacggaatcagactgtagccgaattccatttctataggctcaacattgatgagcgaatatacattgtttacatcccggtaataggattcttcatctgctgcaggctgagcactttcttccatcatggaggctgccgcagtttcctggtttctcactgccgcctgccttaccttctgctgcaaatggtaacccgccgccaccagcatgactgccataatcgccagctgaacctttggcattccgggaaccagtatgagaatggccataacaaagccggtgatcataatggcattaggctgagccaggaactgagcagaaacgtcttcattcaagctgccttctgaaacagctctggtaacgatcatacctgtggccgttgaaatcaaaagagccggaagctgagagacaagtccgtcacccactgttgcaatggaataaacggttaaaacctggtcaaagggcatatttgactgcaccataccaatgatggttccgccgataaagttaatggcggtaacgattatggacatgatggcgtctccctttacaaacttggtagcaccatccatggctccgtaaaaatccgcttctttctggatcttataccgtcttaatttggcttcctgttcattgatcaggcctgagcttaaatccgcatcaatggccatctgcttacccggcatggcatccagagtaaatctggccgcaacctctgatacacgctccgtaccctttgtaataacaaggaagtttaccaatacgaggatcaggaatatgataaaaccaacgactatatttccctgtaatacaaaatcaccaaaggccttgatcacctggccggatgatccctggtgggataagatgttacgcgtggtagacacgtttaaccccagacgcagcagggtggtaaccaaaagcagagccggaaagatggaaaactccaatggctctcttatgttcatggttatcaataagattatcatggaaagagaaatatttatgataatcattacatccaataaaaatggaggcaatgggataatcaacagaagtacgatcgtaataacaaaaaatactacggaatttttcagtaaattcttcattcttttacaccatttctttcaagtatctctgccgcttttatctactcaataatcttgttattcatacggtatacgtaaacaagaatttcggcaaccatgccgtaatattccggcgggatctcagctcccacctgggtgccggcgtaaatccctctggctaagggcttattctcaagcacatacaccccattttcctcacctactgctacaattctaagagccagttcatcctggccttttgccaccagtacaggtgcactgtccttttcaatatcataccgtaacgccaccgcgtaatgggtaggattacgtacaatcacatctgcagtagggaccgcctgcatcattctggaacgggcacgttctctctgaatgttacggatcctccccttgatttcagggtttccttccgtctgtttgtattcttcctttaattcctgctttgacatcttgatctggcgttcaaaatcccaccactggtaaaaatagtcaaatccggcaattgccagaaatatgatagacacctttacgatcatttcaagaatggcattcagcacataaaccgctgaatcctgaagttccatgtcaatggtcctcgccaccgctcttaaatcccctttaatgatctggtaaaggatcaggatcaaaattgtgatttttattatgctctttaacagctccacaaggcttttaaacgaaaggatattcttgatacctttaagcgggttcagccggtcgaatttaggagccatattactttgggtaaaaagaaatcttgtctgtactcctgtggcaaccactgccaagaggaccgaaaccagaagaatgggaagagaagcctttgcaacggctaccaccgtatctatatatgcctttgtcgtataatcggacaaggtctcagccgatgctgccaggcttacgtactttatcatgtaattccgcagggttttgtacatgagcggaaacaacagcttaagcatcatgaatatgccgagaagggaagcaaccattaccacatctttactgacggcaacgtggcccttctttcgttcatccttccgttttttcggtgtggctttctcggtttttgaatcacctgccattgccgttcatcacatcctttcctcttttccggacatgctttccggacagggaccgtccagctttagggcctgccccgctttatcgggcaccaggcgtcaagtttatacccgcagggtgtttactaaacgcttataaaagcctgatcatgctctggaccgtaagaagcatctgagttattacatcgcccaaataatctgacatgggagaaaacaggaaaaccagcataagaagcccaagtatgagctttgcctgtatatttacaacaaacacgttgatctgaggaatcattttcatcaggattccaactgctatttccgttataaattcaattgctataataggaaatgaaaatttaatggccatgattatgcattgaatgaatacctcaatcatcgcccacgccacttttgttcctaaaactacctgcccgtagggaactgtctcggcagatttgataagcagcttgatcagagccagatggccatccaccgcaaagaaaagaagaatgaaatacacattccaaaggcctccggtaatagcgacctgagcgttgctctgagggtcatagattgttgccatggacaatcccatctggaaatcaataatggagcctgcaaaggtgatgaccatgagaaacaagtccataacaaaaccaatgatatagcccatgataaactcttttattatcagtaccgcaaattctatggaattgaccggttccggtacctgggctgctgaaaaggaatagatcaggagagtgaataccatgaccattccgccctttacaacattgggaatattccttcttcccagaatcggattcagcaggataaagcctgacatcctcatgaaaatcagggaaaacagcatcatttgtcctatttccggcatttaaacattcctttccctttatcctaacatggtgctgaaaatatgtatggtaaaatcgcaaagagtatccatcatattgctccccatcatcaaaaggatcagccctatgacgatcagcttggggacaaaagtaatggtctgctcgtgaatctgtgttgcggcctgcagaatggaaataataacaccgatcaccatactcaccaccagtaccggaccagccagctttacagccagcccaaacatctcatacatcaaactgctaagtgcaacttccgtcatattctatcctcccgtcagtagtgaaaactcttcaccagatttgtaaacaaaagctcccagccattcactgtcacgaataaaagcagcttaaagggaagggaaatcatagccggaggaagcatgaccatacccatggacataagggtacttgatacaacaatgtccaccagcataaatggcaggaagatcataaaaccggccgtaaatgccctttttaactcagaggtcataaatgacggaattaccactgtcattggaagatcctctatgttttccggcatatccgtatttgacaaatcaacaaaaagattcagggtcgttttctctgtctgcttcagcataaacttcttcataggagcctgagcccggttcagggcctctccctggctgatttcctcctttatatacggctggtaagcgttggtattcacatcctttattacgggatccataataaacaaagtcaaaaacagcgcaatccctacaagcaccatattgggaggagtctgctggattcccaaggcatttctggtaaaagataagataatgacaatcctggtaaaggatgtcatcatcactaatatagagggcagcaatgaaatgatggtcagaatgagaaaaagctccagggtcggcacccttccgccgtttatattaaccaaggcatctgtattcattccattcctcctcacaaatctttcttgtgtctgtctgtgtatttctttaatatgtttttaaaattttcgtacccatctgccccaaaagaaggaggagcacctgtctctttgggaacttcctcttcagaaagctccgcaagcagagttatttgagaagaagcaataccaatcagataataacggctcccagcgcggataaccgctactgctttatcctgtccaaggggaagcctgtccagcatctgcatacaggttccgccccgcttcataccgattccatttccaaggctctttgtaaacagatgacttaagtatagaaccaaaatggtaagaatcagtaccgatgccagactaattatactgctcaataaagccacttcctctctaatctacgttcttcttcgtgatttccgtgatacgaatgccgaaattatcgtcaaccacgaccacatcacctttggcgatacaccggccgtttacatataaatccacctgatcaccagccagcttgtccagtatgaccaaagaacccttggtaaattcaagaatttcctttaccagctttctggttctgccgatctcaacagagacctccagaggcacgcccatgatcagttcccggttttcctcctgctcctcataagtcgcctcgccttcccgtaaactgttctggggaatcggcttgacgtttatggtcttaggttcctgaacttccttctttggagtgctttgctgcccgctttgcagctgcaggatcatctgctgcatttgctgtatcatctgctgctgcatctgcatctgctgcatcatctgctgaaccgccatccggtccgtttcggacatctgacttgcgggagccatagacggagccggctgctgctctgttttaggtggttccggagccatgctgcccgccaaaagcttctcgatctcttcctgtgataaaatgccgccacttgaatgaactggctccggtgccttttgaggttctggggccggttcaggctgtacgctgcccgctaaaagcctttcgatctcttcctgagagagaattcctccgcctgacatggaaggggccggctctggagcctgtgttggtgttggggccggtaccggtgccggagctggttccggatcctgtgcctcgttctcctgaggaaaaaatcctccaaccaattcctttgcaaggcttggaggcattacattaataaactcactttccagctggtctgcaatctttaatgtgaatcccacgactaccataaggtcttcattatgataatatttttccttgaaatcattgatatctgcaatttcaaaggaagttggggttgaaatattaacggtcttacttaggaattcagacagagccgttgcagatgaacccatcatctgattcatgacctcacaaatagcactgatattcagttcattcagctcaaactcttcctcaggggtttccatccccatcagcatatctacaattacttttacatcatgtctctttaaaagcatgagattacttccgctaagtcctgctatgtaagtaatctccacccctatcgccggttccaggtttgaaatttcaaattcatcctttgacaataccttgaccactggtgtggtgatatcaactctggcattgagcatggtagatactgctgtggctgaggcacccaggcttatattcagtatttcacctatggcatcaatctcaaatgcgctaaaattcttcgaatccatacaactcttctccctctatactcatttagccctctatgccatatacgcattacttcccgatttccaacgccttggaagccattgtcttcactgcattaaatgcagttatgttggcttcataagacctggttgcagacatactgtccacagtttccttaatcaggtccacattaggcatctgcacatagccattttcatccgcatctggatgttccgggctgtagacggacttgaagggactggtatcttccacgatctgtgaaacccgaactcctccggtgctctgctgccggcctaaaccagccgcattcatcaggaccctccggaaattgttttcactcctggcctcaagaactaccatctttctccggtaagggccaccggcttctgtccttgtagtatcaatatttgcaatattctccgatgcaatatccagccgaagacgttgtgccgtcattgccgacgcactgatgttcatagaacttaagaacgacatatgtaccctcctccagtataagacctagccgatgatacctgtgactgttttcagtatacggtctggtttgaaaggtttcactataaagtcctttgcgccggatttgatcgcttcgattaccatactctcctgtcccatagcggagcacataacaacagccgcattgggcgctttggccttgataagctttagtgcctccagcccatccatattgggcatggtaatatccatgattaccaggtccggattaatttctgaaaacatctgtactgcctgcgctccatcggaagcttcatacaaatcggtatatccgttctttgtcaaagtatccttaatcatcattctcataaaagccgcatcatctactaataatattttcgccatttctttgcatctccttttatcatccttaattctttatgtaatccctgactcagctttcaccggtctggtaatttccttcttcaacaaggtcttcgatccgaaccgccacattccgtttatggacgccaagctggcctctgaaccatggctggttttccacatacagctgtacgtttgaatccttcggggtgcctaaattaatgacatctcccacatgaagattgtatacatcatcaagggtaatcaccgcttctcctacctgggcatgaaccagtaaatcggaagccttaatgctgttcatgatttcctgtttattatcctgactgttagcctcatcccccatagcactgtgcttccgtttatccatggtatcaaaaatgttcatgagcagatttcccggaatgcagacattaagtcttcctgagcactccttcatatctacatcaatgacaacgatagcaatggtttcatccacaccaatttcctggaacatgcttggattttcctccagcctgtccagttcaaaattcagattaatatagcttgaccacgaatcctttaacgcacctattatatattggatcactcttcggtataaaaccacctcaatttccgtataggtataagatgcgtcaacagccgtatcatctcccactcctcccagcatgcggtcaataaggcttaacatcagtgtcatgctgacattgatcaaaagcggagggttcttggaattatccggcagcgatacattgacaatcgtaagaacatcattatcaccaagcgcattgccaaactcataatacctttgttcctctacagtaactaccgacaattcactggatgtacggaataaactgttgatctgggaaccggcaattctggaataattgtcaaagatactttttaaaatttttaatttatcctttgtaaactttttaggactgtaaaaatcatacttcctgtattttatttcattttctttcttttcaatctcctcgataggctcatctgttccctgcagggaattgagcagcgcgtcaatctgactttgggataatatttcagccatctgtttcactcccgctaattatttaattgcctgtttcttcctgactgttatgatatacctggttatagtattcctccagggacttttctaccgtatcattcttggttatcaagatttccacacgacggtttttggcccgtccgtcttccgtatcaaactgcgcaatcggacggaactgtccaaagcttaaacccaccagcttttccggtgaaacggcatttttgctttggagatagataataacttccgcggaacgctgggcagacagcattctgtcattacggatattattcggccttgccgggttcccttgggatgtatgccccaacacctgaacttcttttatagaattatttgcctgtaacatagcagcagcaaattgatcgagaacgtcttttccttcctgcctgagaaccgaactgtctccgtcaaaaaatactttatcacgaaatgaaataaatgtgaagccgtccctcgactaatttccacactatcctgcatatttcgctcctcaacgatctgtttcaagaccagatacaactcatcgaaatctgtagccccgccgctctcgtcgggaatgccgcctgtcaagtcccctcgccttccgttaccttggcatccagtacaacctggtccgattcttccaaggcgctgggattaaagctttgcaccaacagcttccatttggactggtcaacggaggacatagaatacagaaggacgaagaagcacagcaataatgtaaccatgtctccatatgtatccatccagcttccaagctcttccggcttcttatctttctttatcatacaaccacctgtttccctgttttaagtaaccgcccatgatccaaaagggcctatgatgctgccgaagcatcttcttttccggtattgccggtttttttcttcataattttattctgttgtccctgggacagataagacagcagcttttcttccagatacttgggattatctcctgcctggatggacaatacgccttcaataatgatttgtttatataacatttcctcatcatttcggatacgaagtttttttgccatcggtccaaacagcagatgggccagaacacagccataaaaagtggtaatcaaggcaaccgacatatcagctcccagactgtttgagcttccgctttccatattcatactcttcagcatattaacaagtcccaccaaagtgccgatcataccaaaagccggagccactgaggttcccttttcgtacatgctgacatcctgatcatggcgctctgacatggctgccacctcactttccagcatttccctgatcttttctgcatccattgcatccacgatcagcataacgctttgcttaagaaaggggtccttaattccgttcgcctgttcctctaagactaaaagtcctttttttctggctgtcttagccatctccaccagggtgtcaatgaccttttccgcattgtacctttggggactgagcatgattccgatatgcttcggaatctgtgcaagaactttgaatgggtagctggcgatcaaagctgcgattgtacctccaacaacaatgataacactgggcatatcaatgaaatttccgattttctccatcccgattccataaataatcaaaacaattcccaatacccagccaacaatcaacgatatatccatgaataacctcccatagcccaggcaatgcctggattaaactttcattctctgcgcgcatgcatatattcgggcattatactcaatcactcggtttatgatctcatctacactttcttttaccacatagtgctttccgctgaccaatattacatttgattccggtatggattcaaccctttcaatctgtccgcagttaattacaaattcctcgtcattgagccttgtcagacgaatcatagctttctctccctttagtccggggaggcggcctccgcctccccgaatcactgtaaaagcatattattaacgcttcatattaaccagttcgtcaagcatttggtctgttaccgtaatgatctttgagttcgcctggaaccctctctgagtggtgatcatctcggtcatttccgtagccagatcaacctttgcctgctctaaataattgccaaggatacgtccttccgttcctccgccctcataaacgcttacatttccggtattggcgccaagagtataatagtagccgctgtctttttcaagaccgcctgtattctgtacgcctgccagggcgatcttaccgattacaatggtaacaccatcctcagaattaccaaccaccgtaccatctgtctgaatcttataattggttaaggaggccagggtgtcatctgccgaagcattgccaactgctgtggaagtagctgaattctgagcggttgtcaatgttttctctgcattttccactgccgttttagccgcagtcagctttgctgatgccgcatcaactgcctgctttgcagaatcccgcaggccttccggagatttgtcctcaatctttgacagttctgtctgaattttatccagtgcagcctttgttgtggtataagcggttttctttgtctcgtaatcaggatctgtagaggaatccgacataatataagccgagtatgccgctgtgtaatccgtcacagcttcatttaattccgttactttagtcggatctaaggcagttgctttcctaacgttggcctgggctacaataaatgcactgtttgcctcgtcatattctgtctttttgtcaagataatctgtctttgcagctgtgttgtccttgtcctccagccacaaccggtatgcatcatccatggcagtcttttttgcatccatatcggcttttgctgcatctacgccggcggcagcatatttcgtgttataattatcgttggcagtaatgtaagcatcccttgcatttcccaactctgcatccattgcattaaataatgctcttgcctcttccagattcttttttgcttctgcaattttatccgcggctttcttatcgcttacacttgccatatcagactttgtcgggatttttaggggagtcagggccgttgtatcaaagctggagccatcggttaagtctccggttcttgtaaagccgtacacataattacctgaatcatcggtcagataaccgtttccatccacctggaacttaccaactctggaaagatacagaccgcttgatttaagcgcatcttcttcaccaagggggagagatccaccgttaatcatgggacctacgataaagaacccggtaccgtcaatcatacaatccaagccactggcagagggagccatgcctcctttaccaaagtcatatgaaatggaacctgtggtaactccatatcctacctgtcctgcattggttccgccgtagcctcctgtctcggtgctgcctcccgagctggaagatgtggtctggtacatggtgtccttaaaagacatactcgccgctttgtatccccatgtattaacgttagctatattgtttccgatgatatccatttttgactggtgagccctaagacctgccacaccagcgaacattgatttgaccatacaatatgtttcctttcttttgtgtaattaccatccttcccagtcaatcggacatgggggaaaagcctccataaatggtccagctataataagatggcgctgtcaatatttgtaaaaatgttttccttcatttcgcttcctgacatggtggttacaactgtgttgttgggaacattcacaataaacgctcccttttcgctgataataaccacatcttttgcaccttttgaccgggctttttccactgcggactgcaggtcatttaaaaatggctccgacatctcaattccgcgctggttgacccgctctgcagcatgcctggaaaattgaagctcgtccttgcttccaatacggctcttcagtacatcgccaaagctgctgccgcactgggacgctgctgccgcactccgcagtttcagctgcctgacatcctcatattggtttactttgtttatcatagttcctcacctccgtctccctcagcaaaactctactgattcgtatctgtgtcggcatttggatcaacagttgtatcagtatccgtatcagtgtcggtgtcagtatccgtgtcagggtccgtctcttcaacatcctcagaaggagcatgtcccttttcataaacagacataacattggcaatggaatatccggtatcatcatcatcattgatgtaaagtgtgggaataccgctgaaaatatccactcttgttactgttccagtgatcttttttagctgaccggttttatctgtggtggcaagcattacctcttttcccatcatggaagttccatagttaatggtattgatctgggaaaaatcttccatagcggtggagaaattgttcattgcctgcatcatggcgatctgggtcatttgagtcatcatctccgagttgtccatgggatttgacatgtcctgattttgaagctgtgcagccagaagcttaaaaaaaccatccgttgtcagctcgccgctgcttgaagttgtggagctgcttgtaagtgcgtttataagagaactgtagttgttcactgaacttacatctgccatcttttctctccttatctatcgtgtttcgctgtcttccgtattgcctgtttcaaagattccaagtctcagcttttggatgaaatcctcacggctttcttccttcctgttttcgtgctgcggctggtgctgttcctgtccgctgccctgttcattctgattgttcagataatctgcgccctgcttgtccaccagaatctgaaccggacgttccagattgttttccagaatcgaccctaattctccggctgactgggataacagttttaaggttctgctctctgaacacagaacagatacgctgacctggctgtcctcataagaaaccttgattcggatcttgcccagattatgaggctccagctgtacatccagctctcctctgcctgcttggatctgttttaaaatctgctgggacagttttgactctaatccttccagactctcagcatttaccgtcgtataagcgatctcatccttttggggctgaatatgcaggacacgattgggttcatgagaggtttcccgtgaaattcccggattttcttccagcttcttttcgtctttctcaacaaaagccgttttctcctctgacttccctttttgtacaggcataactgcctcttcctcttttctcaccgggaccgtatcaaatgtcccattgagctgcattgctcccagaatgccattttcgccttcctggtcagaacctgcttcattggcctgtcccaaaccttccaggctcaaagattccttttggcctgcggatcgctttggctctgccattgccggcattccaatttcatctgccagacttatatcaggcatctttccccctgcttccggtaaaacggctgccgcagcatcttcctcaaatacaagctcttgtccgggtttctcggttaaattctgaaaccggagctggttcaacgcctggaactgatccaaggcctgcgtcttttcgccttccttaagcatcactccctgaacgttatcggtcccagtgtcctccgccggtttctggcccagcccctgccccatcaatcgaagcatttctcccggattctgcgtttccaccgctccggcagccaccagaaccgctgcagtttcaaccgccgcgttttctgtcatgtttccggaatccttagtttcttcatttccgccgtctttcttctggctcttgcttttcagcattgtcttgaaaccggaaaatccatctactgccttttcttccttcttccgtgtccccgtcatctgccttgtcaataagtctatgctgctgttttttacttccgccatcttttccctcctttccttttagccgtacggcatatgatttctatggtaaactgccaaagcttgtttctccggcagaatcacctgttgctgcgaactgacatggtgttggaaacaaattcctcaatgaacagttcttcactgcgctgtacttctttgttatacaaagtcagctttttttcttttaatttctcaatggaagctttctcttttctggcttctaccacctggaagcgcttctgctcctcttttcttttaagcgtcagcaatactccctgttctgccaggatcttcttctccatatgggtgatatatgtttcatattcacgcatggcattgatggaaatccctgtctgcgcttcttctttaaatcttacacaggcagcattcctctggtcggccagcatattgatcttattctcctgctgcgcaaccttggccagtatctgagcatgttcgcttttcaaattgtctaaagcctgatccttgtaatttaaaaccgtatcaagagggaagttaaattttttcatcttcatcctcctttccaaagcctacgctaagatcgatttcatcttaatcagtatattttcataggtgtcattttcctgaatcccctggcacaggaactggttgaccttgtcaatcctggcaatagccaaatccagcttgggattggttccgcttttatatgcgccaattgaaatcaaatcttcatttttctcataaatgcttaagatatccctgatttccgaagcaagtttccggtgttcctcggacacgatattggtcatcagacgggaaatactggcgcttacatcaatggctgggaaatgatttgcatttgccagttttctgcttaaaacgatgtgtccatccacaatacctcttacggtatctgcgatgggttcattggtatcatcaccttccaccagaaccgtataaattccggtaatggaaccttccccaaaattaccgcttcgttccagaagcttgggaaattccgcgtatatggaaggagtatatcctctggccaccggcggttccccgatggcaaggcctatttctctctgagccatggcaaaccgtgtcagagagtccatcatcagcagcacatccttgccctggtttttaaaatattccgctatggtggttgccaccagagggcacttcatgcgaagcatggccggctgatccgatgtagccaccaccaggacagatcgctccatcccttccggccctaaatccttttctataaattcccttacctctcggcctcgctcgcctacaagggccaccacattgatatcagccttaacgtttctggcgatcattcccaagagagtactcttaccaactccgctccctgcaaaaattccgatacgctgcccttttccaatggtattcattccatcaatggctttgactccgaattccagcttgtccgtaatgggaggacgggtcaagggattgatataggggttttccacataatagtatcttgaagaatcaaaggggccttttccatccattggttctccctttgcatcaatgatccgtcctcttaaaaaatctcctaccgggatctttaaacggcgtttcgtattgcgcacaaagctgcccgcggcaattccattcatattttcgtaggccataagctggattttatcatccttaaagcccactacttctacgggaatctgctctttcctgtcttcgttataaatataggcaatgtccccgatactggcctttccgccggaggcttccatagacatccccacaatattttcgatctttccgatgtgatcaacggtctcagtcttcattatgagatcagacagttctttaaacatgaggacacctcctgctacagtcttgcgttattgagaattccctttatattttcgatctgggtattcacgctgacatcaataatctcttccggcaattcaatgatacaggtgccatcctccgcatgatccatggcaataattttgatgtttccagaaatatgggacaattcatttagcaagcccacatctccctgtatcatcatccctgcatccttttgcgaaacatagattttcacccactgggtctttttcagcttaccggcagcggcagcgatcatccgcttgatgatctctccgctggattttaaactggtctgaatgatcttttctgctatggtcaaagtaattttcttcaaatcatccatatatctttccagaattctttctttctcttccgtaacacattcaatggtggtcttcatggccgcctggaattcttctatcttgagatccaattccgctttatgatcctcataggctttcttgcaaccttccgaaaaccctgcctcatagccttcttcataccctgccgccttcgcctcagcacggatcttttctgcctcttctttggcttgatccgtaatctccccggccatttttaaagcattttcataatatacttcggcagcctgaagatattcctcatcagcatcgtcccggaactgctcaatcttttgctcttcctcttcttccgtttttgcctttactatgatatcttcaaacgccaggtcaaatccatactctaaaacatgacttgaaagctgtgcgcccttaataatattagacaatgatatcatcctttccgcccttgctgataatcagctcgccttcttcctccagacgcctgatgataccaacaattctctgctgagcctcttctacatctcttaagcggacattgactgtaacttccatatcggactgaatgctatccttcatacgggttgacatattactgaaaataacatctgcaatctgcttatttgcattcttaagcgcataaaccatatctttcatatcgcattcgcggataaaacgctggatggagcggttgtccatggtgatgatatcctcgaatacgaacatctttttgcgaatggtatctgccagttccgcatcttttctgcccaactcgtcgaagataagcttttcgtttcccctgtccatatggttcataacgtttgcaatataatcgataccgccaaccgttgtgtaatcggtggtaagaatgccggagaacttcttctttatctcactttccacaagccttattgcctcaggagaggcactctccatcctggcgatggactccaccacccggaaacgtttttcaggcggaagctcggaaatgagctgtgctgccatttcttcatttgtgtaggaaagaaccagggcaatcgtctgtgccctctcatgctgcagcactgaaatcaaattctttgaatcgctctttctgatgaacccaaatgacctggattttaaggactgagtaaccttctgaagcaggctgtttgccgtgctttccccaaatgccttttccaaaaccgttcttgcatattccaggcctccgtcagtgaccactttctgtgtcaggcaggtcttataaaaatcatccagtacggcttccgttgcatcagcttccacatgccccagttttgccacttcaacggttaatttttcaatgtcttcctcactcaggtacttatatattttggaagccttatccacaccgagtgaaacaataactattgccgctttttgctcaggcgttaagttagttgtcattattgtttcctccgttcaaccatgttttcaacagctgggctgatatctcaggattttgttctgcaaagtcacggacactttcacgcagctctgcacccctgtcctcttcgggaaccaggatctctctttctctttcgtcttcctgttcttccgaaagttccggaagaatgggaacatcctcctgactgtctcccatatccgccataagagcttttttctttcttctgcgtctcactgcaagaattatgatcagcaagagcaggaacactcctgccagtgcaccgattaaaatccactgatttacaagaataccatctgttcctacctcgacaggagtttccggctgtttcggaacatccacggtgtagaagggcgctgcaacagcagtgattttctccgcccggtctgcctgagcaattcctgccgcattaccggccaaattccggatatcatcagccgtcaaggttccgaaaccgtttccattcacgattacagaaaccgttaaattctccagactgccgggattaacctgtccctgttccttgatctggtttaaaagatactttctggtcaggctgctggaaccataagcattattatcccctgcagctcctcctgcattatactgaggaatatccgcattggcctctgatccggccactccggaagcggtctgcccatctcctgaatactcccggtatatggattcctcagaagtaagtcccgtcttatcattctcgtcgatcttctccggtacattgtatacagtactctcccggatcagcttttccatatttacagtgccttttacggatacgcgtacatttccatttccgtacacaggtcccaggacattcataacctttgctgcaatctggtcttctataagctttgcgatctcttctcctgtctttccagaatttatatcctcttccccggaatcagtagagacctcttttccgttgccgtcaaacactgcaacatttccaatgaccataccaggaatacttcttgaaataagaagctgaatggatttggcctgttcttctgtaggggaaccgccgtctttcatcacgacaacagcctgggcactcgcttcctgcgcattgtcttccgataatgcgtacttggaagtttctcccagggctatggttacgtatgcttcctgaaccccatcgaacagctggatcgtagacccaattcttgtttccaaatcataaagcttaaaggtctgacggtctgagtcagttgtcataaggtttacattgtttttgaatacatcatatgtaaagccgcttttgggatatccctcagataccagctttgccttggtcatatccatctgggctgtcggcaccagaatatccccatcatgatattgatagtcaaccttgtcttcctgcagcttacctattatttgtttcgcttcttcactgccaacgcctgtaaacatgacatcatacggcttttcccgcatggacagtgccataattatcgcgccggccacaacagccacgcctacaacagaagcaattataatcttctttgctttgtcacttaacttacctaaaaatcccttaattttttccatcgtgcctgtccgccccgttatctacttatatattaattcttatcatctcattataagcttccagcgctttattcctaagggctgttaaaagctctgccgataactgggcctttgccgctgccgccggtactgtgtgggcatcatcgatctgccctgtggacagcaggtactcctgcattgtcagattttcatccgtacttctgacgttctgaatcgcttctttaaatatatcctgaaacatggtgcttccggtttgtccggaagtcacctttttttcacttcctatgtccgcaatggaacttatggggaccattggcgttataaacatctgctgcattgtatgtacctcctgttttaacctttaattattgtacgaagcctggttatctcactgtttaatgcattgatctcatattggtactgaagagtggtccttgccaattccacactttccacatccgtattgacgttgtttccatccattcgggcggactcatcatgtgtatttcgtacaaagtatctggaaccatttatgatattgccgatatccttagaagtaccctctcttcctgccatcaggcgtttgcgaaactcatcttcaaaggttacatattgggctttatatccaggagtgtctccattggcaatattgttcatggttatctgctgctttgaccagagataatctaatgttttctccgccatggaaatgttgtttccaaatattgaattcataattttgttcctcacttttatcacttccggcaaagcgcctgagaagtgtatttagctgaataaaaactgcataacagttaaatatcgacagccttttcccaaaatcgatttttttttgtaattttttctactttattttacattttattacaaataatgtcaagaaagttctgccattatagtccggaatcttagactattttctgccgtaagatgcaataactcttgatttatctacatttcttcaggaaataggtgtaaattatttccagccaagggataaactttgggggatattcggccctttttaggctttatctgaagctttttcaagtctccgagctgattttggtcgctgatttttaatttatccggttatatttcctcctttttttatttatttattgttgttattgaaactcgatgcaaaaaatgacgaattttgtagattggtgtttttttccattatacaattaagaaggggtttgtaaagaaaataggatggggtgggagaatgtgatttaccgagtggttgtttggaaatttacttttcgtattatcaaatataatctagaaacaaaattaatttaccgcacttaatatattatgaaatatatatcacatagacttccaattttctcatgcctagaaatactgttttatctaaaaaattcttttatttctgccgaataacagatcatcgaatagaacagtttttacagacgttggaaaaatactggtatatagacttgcaatagtactacgattcgtggttttgggcttgtcaatagttccatgaaaataatgtttcttccgcaaacagtttcaattttctttgacgaatagatatttttaggataagcatagatcaaaatctcaaacatatctttagttctactgctgaatattttgcctttggaagaaaatcttgatgcactttgtgcaatcaaaactctccaattcacgctttgccagtgagacagaggcattatcagaaaccagaactttcaaactcaacagaaaaaccggttagtagttctggctgagttcggtataatatttagtagtgtaattggttattaaagtaattaacgatatcactgattacagactctttagggtccgtttctctgttttatgtacaaaaaaggggctaaagcccctgtagattactcctcctccattccattctcgcatagtaataccatcatagtattcttatcgctaacattattttcaacccaattttattctctccattccaaagcgaacggcatttgttcaagttcataatagtccacacccactccaaaaccatagaactcaagtgcagttcgccgatattcaagttctccacccggtgtaagcaaaacaaaatatttgccgctttgtccatacaacatatgaggagctattgacattacttccagctttgaagcttccaatgacggtatggtaataatatcatcaggttttgcacccatagcacaaagtgcaagataattcggcaaaagagaaatttcgtcgctccataaaaccaagcggcgcaagccgattggtaaatctttttttgcatctttggtagaaggcattcctgccatggcctctaacattttcattgcaagcgtataacttcgttctggctttaaatgcatgataaaatcagtaaaatgacctcgttcataaattacatcattcatctctacaaaggcagctcgtggattattggcacaaaaatctcgaataaccttatttaaactcatgatttgcatgtggaattcagcattgtgtggttcactatcacgaaaataatcatactccggcccggtcattagaacaagtcgtgttttgtctggtagacgctctgcaagccattccaagttttcacgaaaccgttgaggagatatcagtcccaaagatataaaatttcgggaaagccactctttcctttccccatcctcaacgtttaggataggggtataggaaccgcttttactgtttgataatacaacgcgcatttgaggaaattctttactctgataaatatctaaagcgaaatcatcgtggaacgacatacatacataatcatattccttctcaaaaatcttcgtggcaaatgcggttcgtccggtatagttatggaaatgagtgcgacagtagatcttttcctgttcattcatttcaaagcaactgcgtatgtattcagtcgcaacattcacaccgcgagcatcaccattaaacgtattacattcgaaatgcacgtttgtgaacggcaacgccatatgtccgaccatgtaatacaagtcacatgcaccaagtgcgtagatttgcaatttatcgaacttggaaacatccgagcaggattgagccgatacaggtcgtaccctggtttcatcatccaaagttatgtaatcaggaacggaaatattgggtgatacgagcgatgctgtttcacctgaaatcatcaaatgcgggaaacccaacattgcatacacatattgctcaatgccaaggtttataattctgcacgaaaacaagaaatgttccagttcgtctcctttaagacaataccagccaataataccatggtctccaaaacgatcatacacacgaattgtagcactctcgaaagcggggtttcgcaacaagtcatttacctcgtcaaacgaaatgcgcttttttgtgaagttcaactgattggtacgcataatcatatcatgaacgcgctcagcatcttcaggcgctgtaggtgacacgcaaatatgaatatcactcttacgcagaaaatcctcattatcgttggaatattggcgggcactaaaacgctcctgcaataatttgtactgttccaggcgtttatgctgcggatccggcttccctgtagcaccaggaagatcacacaaacggttaaggtcttgtgcagcaagaatttgtattccaggattgtaaaaactcacttcctcaagatttgtgttattatcatctacaaacaaaacattgggcgcacgaagctgcatatcagctataatcctcttcaccgccccaccttttggcgtgaattcgatatgcggaaacacaaagtagtcccaaatctgtgcctcgcataatacagccttggccttatcaaagtcatttttagaacaaatcgagttgacaatcccccgatttgtcaactctttcacaatattaatattgttttgaggtatagtaatgtaaccctcctcagcaagcgtgccatgccaaaatgtttcatccaaatcccaaatgacaagtttaatctgttcattattcatatgcctacccctgttctgttccataacgaatacagctaatatatattactttaacccaatctagccttaacactctcaagaatcttctttgctatggtaccgtccgaattcgggaattcccgtatgcggaattcggcacgcgcttcacgttttgagtcctcgccattttcaatctctcgcagaaatgcatccaatggggcgaacacgctctgttccgtatataaccgcatactttctacatctgagccatcatccggcagtggctcatcgaaattctcgtgagcaattgcactgtaaaaagggcttctcaaacgcgccgccagtgcacttttggaatcttctctccccaaaagaaataccggaagatccagaaacaacgaatccatcacgatagagcttggaaacagtgaaacaacagcattggaatacatataagcaggtgtaatgcttggcgtacgatctaaaatcattctctcgtgcgcatgtgcaaaatcaagcatgacctgcatttcgatggacatcttcatcaggaatgcctgtgggtgtggccgccatataaggaataaattttcgttttgcgcgaccgaatcaatgagccggcgcacaccaggatgagtcacaactccttctgccatataagtatagtgggtattcagaaaaattacgcggcgtttcccaattgccgactcccattccggatatcgggtaaaatttccgtgtatcttggcatcatataggcagtcacattttggatgcccaaattccaacgcttttctctccaacagagtacctttcgtatattgtttacaaaacgccttactctgagcaatatatatatcacaacgctgtatagaatccaatccggtaagattgttttcatacgactttcccaatgcactggaagcggctatgccataaggtatataaaccatgcagtccgtattctttctaatgttttgagactgaaacttcgggatattaactccgtcataaggctgattataaaacacaacatccggcaaatcttcctcaaaactgtatgcgtcatagtgcgtgtttggaatccctgcaggggtaagataatcctcccaaatgaactttgtgcctacgtttgtattacgcataataggaatgattaccacttcagtttcaaacataggatcgctagaaaacacatcgtatacgcttttcatagtttcccatgtattatcatagtatggaagaaaaagagccttgtacttatcgggttttaattcaaactttatactattttcaatcttattcagttgccgccgcaacggcttttcgcctatttctccgttatatgccctatataatagatcacaatattcttccagcagttcaaccgcatttgtacctttgccttctattttctcaataaattcaccaatatgaagagcaccactttgacaactttcatataaatgctccgactgcgcttccctgattgtttcgagcaattccaatagttgccgctgatgtcgctttctcatgttcgacttccttcctgtattttccttgcaaaaatgagagtttaaaaatgtcgtaccttcaacaccccgataaatcacactgcatacagcataaaattcgtgggaatcaggtccctccataataacgtaaataaaatttataatcaggattcatcgcttctatcatgcgcggaatctttattatatcctcgaagtcatagtacagtgcaataataagatttggatgattcttatttatatgaccttttgcccccatcaaaacctggctctcatatccatcgacatcaatgttcaaaatatcgattgcttcggccacatccaaatcaagagaaacggttctgaccggaatggcttccttatcagaagtaatatgagacataattggatcatctccactggcatcaaaaggtttttccccttggaaggagtcaagccccatgggccgtatctggatgttttcaaatcctttcagattttcctccagcttcctggctgaggagtcattgggttcataacaaataatctccctatagtctcttccataagtttttatataattaagactggtatttccaaaataagcaccagcatccacaaaaacctttccccttccctctgggataaggtccaaatcatagtaatcctcctgccctttctttattcgagaaagtctgtctgtatccaaagatatccagttcttcaaaatcgctgtaagtatcttttttgactgataatcagacaacttttgataaagccacaaaaagtcttcccagctattttttacacaggcaattcttctttccaatgctctgtaattatcttccgccggtcttatctcgccccaaaggtgaaaacgggaaaagttttctgcataagtatctattactccgccataagccttgttcaactcaaacaatttatttttaaacgaatccatcagctcagggatctccttggaatgaacacccttcataaaagcaagatattcccaatccagttcattacggcagtcaaagcctggaaattcttccctgacctcttcctctgaagcagaatacagcaatgcctgattttgttctaatagctttctttcttccaaagacaacaaaccgtaaatccgctcctctaaggcagaaaaataagccagcttagaagacttcaacagaaaaagccgatcctttgcagaagaaagatcataaagtttcgacaaaaatccaaaagtagcctgagccgtctcttcttcccggattcctttttcaaaagtagaagaatttcttttaccacagcttcctgataagggtttgctcttaaagctaaaactccgtatcggatcatgtcagacggttgccccagctttttgtatgacataaaaatcttcctgtatacactggagagattccctgctatagccagattgctgagcatccggtgcttatccagttgcgaaagtgcaagttccagataaaaacgtccttctcttccattccctgttgataataccaaaatcccagccaatattccacatctggggaaatgcaatcattgtctttggctttctgatatatagaaaggacttctttctctccttcccaacgggtcatatacttaattttgagtaagttgcaataagtcgcatccttcctatctatcatgacagactctcccatatgttccatcacacggatgtaagcggactcagcctctttaagtttcccctcagccaaaagtgtatcacccagataggaccaggcattataattttctggttccctttccacctcctgctccagcagagaaagattacgtcctatttttccagtctctttataggcagcatcactatatcctgtgtgatagatggtaagcatatctgttgcatcaagagttacaaccttatcacctcccctaaaggaaagctgttcatgaatccggttttcataacggagtaagggtgtattcttaaatatacggctctgcatagcagtagaaaacacctctcccgaatcatttaagttggctaacatgctccttataattctaggtcttttcttgagggaaaactgcttttcaaccctgctaagcaaaggcaagatcttcctggcatcttcttccgaaaaatattcgtctgcatccaaaaacgcaatccaatctccctgcgcttgctccagggcaaaattttttgcagcggaaaaatcatcgttccaagggaaatagaacacttttgcccccatttcctctgcaatccggacagtattatcagatgaaccggtatccacaacaatttgttcacagacaattccctttccccagctcaaagcatgccggatattcttctcctcattcttaacaatcatacactgggaaagccgaactgtaggcttcatagaaaatctcctcctgatttacgataaaataacccccggaagaaaatccttccggggaaatgaaagaaacaattaccgtaataactgtaatactccctgaggaagctgatttgcctgagcaagcatagcctgggaagactgtacaaggatattgttctttgtatagttcatcatttcctgagccatgtcaacatcacggatacggctctcagctgctgtcatgttctcagaagttacacccaagttgttgatggtgtgctccagacggttctgtaaagcacccaaatcaccgcgagtggaggatacagtattaatagcattcttaatcagtttaatcgcactggaagcgccactttgagtacttaagtcaactccattgattcctaaggacttggagctcatactcttgacactaactgtcaacttattaaagtcatcagctgtatctccaatctgcaatgtcaaaccagtaccatcacctgtgacaccagagtctgccgccggtgttgcctgtcctgcaaacttacctacaagaccagttgcaagtgattcagctgtatcagcaccgttagctgtaaattcaatcttacctaaaccagcttcagttaagtcaattacaccagtatctccagtaccaagggcacctgttccaagagcggttccatcagactttttaacagctttttcaagatcaataacgatatccttagaagatccatcttcctttaaaatcgtaacaacaacttcgttcgtcttagcaccagcaccattagttgcggtaccagctgcaactgaaactgtatcacctgacgccagagacattccagaaaactttgtaactactgtacttccaattacagttcctgctgcaggctgggtgctaagctttgttgatgacttacccatgctgccatctaacagattgataccattgaagtttgtaccctgagagatacgatcaatttcatctgttaaagatttaacttccttctgaaggttttcacggtcaacagcatcctgataggttccatttgcagactgtccagccagctcaaccatacggtttaacatggagtgaacctctgttaatgcaccttcagcggtctggattaaagagataccatcgttggcatttttctgagcagtctcaagacctgtgatctgtgctctcatcttttcagagatagcaagacctgcagcgtcatcgcctgcgcggttgattctgtaaccagaagataatttctcaaggttcttggatactgctgtgttattgctgcctaactgtctgtaagagttgattgcagcgatgttgtgttgaattctcatagataatttcctccttgaatgtgttacagggaattccttttccctgcatgatatgtttttcctgaatcaggaaataagtaatgcttttgatggaatcctgcggggtaccatccgcattcatgattccagacatttgacacttgtgtctttgggaagtctacttcctttcatctacattatcgtaccgataggaataaaaaataagtctttttttgaaatatttaaaatattttatggcagctgagaacaggttaggaccatgtcattagttgaaaaggaggatatacatctgcatatcccctttccttaagctctcacattcacaaactgaccaatcccgtctgtagggggttgcctggaaaccgccgcatcagccatctgaagcaatccggcggcggcaagttcctgggaatcaatggcctttttcgcaacattgattcctgcactctgctgtactcttgcaaggctcatttccatactgatcgcaccaatatccatactttcatctccaaataaatccctttttttaaacaatattaatccttttttttataaaatattcctatcttccaaaacggcaaccaatgtttcgactttatcattgacttttcctatttttttgctagtatacttctaaacttgttaacctgaaattaatatctttaagtttacgagttgtaatgtcctgtttaattaacagtatttcaagctaatcataaatgggctttagcttcttctccatcaatgcagctgtgacatataaatcctctttgattaattccatacaaaacccaccgttttatatagtcatatcatactatatccgaaatgtaaaatatagtcagctaccgcacaattaatagtgaggaataattttttttattctcatattccaaattgttgtttttgattttttcactttatccactttcttttttattgttattcaccttacgaagaattccatgatatatataactgtataagaaaatctgctatctgcgtataaaggtaactttcagacaaaacctggggattttttttaagattagataatctaactctttaactctgtttttatacactcccactgtggaacaaccttaaaatcaagatatcggtcatgtgcttcgagaaattcccctcctggcttattaaaaagatctattgtagattttacctctatctcatcataacttacactaccgttttccaaaaaataatctagataacttattttagagggattcaggcccataagctttacagttacaatatcagtggaaagtaggtcttggccggccacaagtatatttgaatattttgttgtagtgcaaaagggtccttgcccttcacctgatatgacaccatcaataattgtaaaataactacgcttttttttatgcattgatttgtacaaatcaacaaccatcctccatattgtatcatttcctggccaagaacccctatgcgttactcttgcctttttagcagcttcaaatgcctgcaaattcggatattcatctccacccaactctggggagccaactttccaatgtactaactgattcttatcagttacactgccaactaacccttttaaattcagtgtggctcctaccttttggtgtgttttcattttaggaatggatatatatacatcagcatcataaagactacggccaaaagtgtataattggttttctcctgtatgagattttatggtctcttcacgctcattaaaaactcctcgaaatagggttgaatcaacattataaagcattgaatctttacctaaattaacctgcacctctccatttggatcgcccgtttgtgtcaccatcttatcacgttgtccataatattttaaatcatcacaaactaatggacgcatgtctatgactctcaatggtactgaatactttgtttctaatctttttattccagtaaactccattaattctgaaaaatctgcatctattgaaggattatctccaataataatttggcctttaccgccaagagccttcgcagctctatcagccacagcttctattattttttcatgtgtaattacagaatacagtgtaccttcatgatcgcatgaagccctccatctcgaagctacccaattgggcttaataaaaacggacatccccggttttatgaattcttcaaacggattatctacattcaagcctaaatctaacataagtttatttaaagaatgttcaatttcaaaatcagagtagtcataacatttttcaatagccaccttatttattttcatttatatatcctctttccaacacattaaggaacatctccaaggccattactaaccatttttgatctccggtcatatcatctgtacagtgaggataaaattccggtctagaaggaccactccaatccataagccattcattcgtcggtctaggcataggtgtttttacaggagcttcaaaatcactatacagccgtttaaacacctctcgtattaaatatttattttcaccctctctaattctttgtaaatctaaaggtacatccaaccgtgtagtgacatatggggtttccagccctattcctgccgtctgacacgcatttgaataggatcccatagcctcttccagaaaaaatccacggcaaaactcatgaacattgatatatccatcattctcatattgttttattggttcatatactgacacagggtttttcagtacataataaggtttcacataagaatatctatcaataaactctccaaccttccaatctttagacatgagtccacttaacccaccataatttaaatcagcactttcaccaaagataattctttcaaatccatccgctttagcctttagacatgccttatatatttgtacttctatagagtgtataggcgctcctttatgtaacattaaaataggtgcaaacttttcaaaatcttcccaataaatctcaataatcttgtgaatcaatccacattcttttgcatactttgcagccgcaaccgtttcatctataacttttataccaggaacaatgcatttaaaagtatataccgtagaaccctccggcataaatttcgctaatacagccgaatcaatacctcctgacaaggccaaagcagctttgccatcctttgtgcacatctcaattcgggtttctaatgctttttccaaatcattactatcttttattaccgttttctcagtaatatctgtatataaattaggaatcactttttccgagaattgtttatttctgtccgcaatcgttctatacatcaaaaatgaactcatacaatactctttatctacgttcatttttataccctccgtcattaaaaaatctatttaaacttaaaatccatgtgccataaaatttcaaaattccatattaaccttcttccctcttatccctggctccaatcaatgtttctgagataattgttgatgacactcctttggtgtatgggaaatagataatctttattccagccttagcaaattccttttcatattccttccatttctccgatccataccagtcatctcctacaaataaaactgtagcatctaattttttacacatagtgagtttatccatgtcgcattgaggtacaactgcatcaacatactttacgcttctcacaatctcaaggcgatcttcaaaaggaatcaatgcatgcttccctttatatattactaaatcatctgtcgtaacaccaacaattaatttatcacacattccttttgcgtttttcagcaaattcaaatggccaatatggaacaaatcataaacgcctgctgtataacctataatcatctttttcccttcctctttatctattaagtgtctacatcttgaaaagattcgtgacgaatattttattcacgatttcggcctcttttcatgataaatgttcattaaaactgaaagaccaataaatcaatccctatcaaagccttgctctaatattatcacaaaatgtcaaaaaagacagtaaaatcaatggttttaagtttactcagaaaacactatatattgccagtaatttttccaacatagtgtctcattggttctgccgtataaagcacatctcttcagatacagatcaacagccttggatattccttttttccggcgcaaaagacttttggctgcattcatttcacagccctatcaatctgcagcgcacccatttctaaaccttctttacaacaatccaaagtaaaccaaaactccaccccacccatcacattccggacaccgcaagacttcccatgggaatccataatagccttaacaatagaaagcccaataccacttcccccatactccctggtatgtgctttatccactttaaaaaacttagtccaaagatttggtaagtcttcctccggaatattctggccggtgttaaacacggttacaagagcttcttctccgttttcttctgccgtgaccacgatttttcgttctccctccaaatgattaagggcattatttaaatagtttgtaataacttcttctattttaaattcgtctgcaaacacaaatatgggaccgcaatcctccagcttcacctctgcctccttctgctggatcaaaataccggccgaattgatgacaccccggatcagctcagtcaaatcgaagcgttccggctgaatgctgtcattgccgaactcaagagcagtgagattaagaagctgacggaccatggtattcattttacctgcctcatccatgatgaccccgcagtaataatccctgctgtcaggatcctctgccattccttccgtaagtccctccgcatatccttgaataagcgcgatgggagtctttagttcgtgggaaacgttggcgataaagtccttgcgcatttcatcgatttttatcttttcatcaatatccttctgcagcttttcattggccgcccgcagctgcccaatggtatccttcaatgtatcagacaattgattcatgctgtttcccaacactccgatctcatctatctctgtgccggtgtacttcgcgtcaaaatccagcgccgacattttctctgacagattggcaagctgaaggatgggagagatcattctttttgtcgtaaagtatataaatatacttcctataaacaaagctgccacacccacataggccaggaaccggtttgccagcagcacactttcccggatgctggcaagggggacggagatgagaaaaatcgttttattgtcagaaaaatacccccagctttccagataataagaatcggaacgcctgtcataggttttctgaacgatataattgtcatgtctttttaaaatactggcttcgggtacgttctttccgaatatataggtctccaccctgtttcttaaaaactgctgatctccgtttgtggacataagggcctcgtctgtggtgctgtcgatcagcaccatcatcagattgtatttttctcccatgacccggaacatcttctgagcagggccttcatttttaaaattcgggtcataggtatccttgtaataatcaatgatccccttcccgctgtcattggcctgtgccaccaccttgtcgatctgcgtataggccctctccagggtgcgcaccttatccctggtgtaaaagctctccagaaaccagttgttcacacaccatgtggacataaggacaaaggccatcagacatacaaaaattatggcaaaacgcgctttgatggaatgtttcattcactcaccttaaatgatatcctttccttacacttcaaatttatatcccattccccatatagtctttatataatcacccttctctcccatcttgtttctcagcttttttacatgagtatcaatggtccgggcatctccaaagtaatcgtaattccagacattgttcagtatcttctccctggacagggcaattccctggttttccaggaaataagccaaaagctcaaattctttataactcaaatcaatgtccttaccgtcaatggtgacctgatgggctgctttgtcaatgcagatccctcctatttccactgcatctgcggtgacggcattgctgcgccttaaaatggcatccacacgggccaccaggatctttgggctgaacggtttggaaatatactcatccacccctaagtcaaagccctgaagctcatcacgctcttcgcttcttgcggtcagcataatgatgggaacctgggaatatttccggatggttttgcaggtctcccagccatccattttaggcatcatcacatcaagaataatcagtacaatgtccttttgttcaaaaaagatatccacagcttcttccccattggaggcctcgaccacagaaaaaccttttacacttaaaaaatcctttaccagttttctcattctggcttcatcatccactaccaatatctttaactgttccataataacctcctgaaatcagatcttttatatcacaaagtatttatcagccatattgtatcaaattgaaaggcagatttctacattttcacagagatttcacacggtttgattagaaatagctgatcaccagattattccccttgccttgaaacggtattccgattcccaagaagcaaaaaagcagatgcgccggaaggagcgcatctgccttatcatatataaaaattatcttaattcagttgtaggaatggtatccatatcatcaaatgcctggttctctccgcccattgcccagatgaaggtatagttgctggtacctgcaccggaatggatgctccaggatgggctgatcactgcctgctcattctgcataacaatatgtcttgtctcattgccctcgcccatcatatgaaatactacgttgttctccgggatctcgaagtacatgtagatctccatacgtctttcatgagtatgagatggcatggtgttccatacgctgcccggatccagaacagtcaatcccatggacagctggcaggtctccagtacgtccggatgaatgaactggttgatcacacgtttgttggatgtctccatggcgcctaaaggcttcttggctgccttttcaatggggatgaaggtggtcttgcaggacttatgggccggtgcacttaccatatagaatttagccgggtttgatgcatcctcgcttgtgaaggtcacttcttttgttcccttggtgatatataagcaatccttatatcccatcttaaattcttccccgtctgcaacgatctttccggcgcctccaatgttgaaaatgccgacttcccgtctttcaaggaaatagcttgtaccgaaatttttccagatatcaattcccttgtcaatggaaacagcttctgttgtaggcatacagcctaaggtcaccatgcggtctacgtgagaatatacggcaactacctcattggcaatgtataaattttcaattaaaaattcatttctggtttcttctgttgtgtaacgtttgaaatccttctgatttgctgaatagcggatatccatttattaaaaacctccttatttaattaatttagaaataactgaccagcttcatcgtatcataatgagatttttaattcaatatcttcttggatatattgttaaaaagaacataaattcttgttttttacttgaaaagtaagcgaatacaggaggaattatccatttttttcctgaactgcaattttaaatttgctcacttctttacgcagcaaatcagcctgcgcggaaagctcttcgctggaggcggagctttcttctgctgtagccgcattgctctgtactacagctgatatctgggtaattccgtaagtcacctgattcatggcagctgtctgctcccgggatgccttttccacggtttccatgagttcacgcacatgccttgcctggttggacacgtccatgagaatggctgcattttcctgggcagtggtcattcctccctttacggcatgggaggcgttttcaaccagcacggcagtccgttttgcggcctgggctgcctgagccgccaggctgcggacttcatcagcaacaacggcaaaccccttacccgcttccccagcccgcgctgcctccactgcagcattcagcgccagtaaatttgtctgagaagcaattccatcgatagactttgtaattttaccgatttcatcagaggtcttttttatttcgtccattgcattcagcatttgcttcattttatcattgctttcttctacccggtcaacggtctgctccacgcatccggtcgcttcctctatatgggcggagctttcctccacctggatggaaacctctgtaattgatgcggaaagctgttcaatggttcctgcctgctcggtcgctcctgcagccaatgcctgggcagcgtcagccacctgggaagaaccggcactcacctggtcagccgactgatggataacctgcagtgtctggttgagctgctggtaaatcagaagaagagaatcgtgaatgggcgcaaaatcgccggaatattctttttccacaggaagcgtcatatcaccttgtgccatatgttccaaatgtacggtaatgtcatctaccacatcacgcatctggattatcagctcatcggttgcctgggacagcacctccatctcgtcctttgtctggcagacgggtacaggaagtgtatgcacatctcctgcggccaaaagcttcagcctgcctgcaatggggcttagtggcgcggttatacggttcagaagaacggcaaggaccaaaaggccgattacgcagatgccaatggacactccaagaagcagcaatatttcaaataccttctgcttttgataatttgcaaccgcaccgtcaatatcgtcgatgtaatttcctgtactgatattccagtcatagggttcaaattttaaggtataagctctctttgcgaacatgccatcctgtcccggtttggtaaagtaataatccgtatatccgccgccggacattgaaccgctttcgatcaaattgcggatataataatttccggccagatcctgttcatcataacgctctttcccctcgtaatcggggttcatatgtacggcgcataatcctgtggatgtatccgcccagaaatacccgtttccgccgccataacgggtatcccgcacaatggcctccgcatttttacgagcttcctgctctgtgatctcaccgttttcatatcgtttattattggtctccaatacgctcacaaggctttccaccgctgttttgatgtttgtatcaaagctttgatagcttgagtcaatccaattctgatacgcgcggttcaagcttacataaaaaattgccgtcaatagtaaaattgtactgaaaactaaaacacttacaaataaaataagtttgcctcttacctgcaatctgtatcttttctgttcatccatgctgcgcttcctccgtgattgcataaacttttctttcatgcaatatcataccgcgcctgagaaatttgtcaatgaaactttgcgcagaattgtatgaaactatttaaaatctcactttttttcatggaaatagtttgggaagtgaacctgggattgccgctaatgtgaaataattaatagttgcctttacaaagtatttttctgtggcaggtaccgtaaattttcctgtttcagcattcaagaattctgaaataaatttatttcaaaaagttcttgacgaaaacaatattagtaactaaaatagttactaaaggaggtatctatgtattcaagtaaattatcggtaagcatccatattttaagtgtgatcgcactgatgggaacgcagcctgccacctccgagtacattgccaccagcatcaataccaaccctgctcttgtccgccgattgatgagccgtttaaagaaggcaaatctaattaaaacgagtaccaggcttggcgcaacagggcttgctaaaaatgcagaagacattacgcttcttaatattttccttgcagtagaagatcatacggatctgttcagcattcatggcaacacaaatcatgattgtcctgtgggcgcaaaaattgaaaacacgctgaagcatttatacggcaccatacaaaccgcaaccgaagaaaaattgtctgctatcacactggcagacatcacaaaagaatttcattcataaatcaaggagggcaagctgtttctggaaaccctaaagacagttccggatgctgctcctgtatttccattcccacggaagcctgcaagacccttaactttttacgcgttattgaaaatgtaaactgggtgggagtgtcaccttcggcagattttggtgccggagaagcaacggttcccattgtagggaaggatcatttgctgacgtcttccaacggccagtctattgtaaccagcggagccatggcagccgccattgtgaatgagatagaagatctccagttcatccgaacaagatttaccgtttgcaaccagtaaataacaaaaaaataatataataaacggaggtacatgattatgagtaaaaccattggaattattacaggcagtttgagaaaaaattctttctccggaagtattgcagactacatcagtgaacacgcaccggcaggctatgaagtgaaaaacatcgacatcagcaggcttccactttacaatcaggattacgatggtcaggacatttccgaatatacaacgtttcgtgaggatgtcaagtctttggatgccgtgctgttcatcacgccagagcacaaccgctccatcccagccgcattgaaaaatgcacttgatatcggctcacgtccttatggtgaaaatgtttggaacggcaagccgggcgctgtgatcagccagtctcccggagggatcgggggctttggagcaaatcatcatctgcgccaggtgctggcatttctcaatgttttgacccttgcccagccggaagcatacatcggtgcttaccacacattaattgatgaaaacggtgcgctaagcaacgaaggcactaaggactttattaatggatttttagccgcttttgcagcttggattgaaaaggtttcctaaattacaccggggaaacagcagaagcttctgctgtttcccttatttcttatatcgacctaaaaataaactgccggtcatggcggttctgacaccttgaaagaggaaagagaggagggtttttaatgaaagtagagatatggattgattttgtctgccccttctgttatttgggtgagataaagtttgaaaaggccttggcagaatttgagcacaaggaggatgtggaactggttttccgaagctttcagctgcataagtcaggcgtacatacaaaagacaaggatattcatcaggtcgttgcggagaaataccacatcagttatgctcaggccaaggcaaacaatgccaggattgccgaagcaggaaacgaagcaggccttcactacgattttgaccgtgtaaaacttaacacctcggaattagcccaccagattatgcagtacgccaaaagattccaaaaggaaggtaccttgatcaagcggtactttaaagcctattttgaagaaggcatggacattggcgatgaaacggcacttttgcaaattgcggaggaagttgggctgaatgttcttccgctaaaacgtgaacttgaacgcggcacgttgaaaaaagggttgcaagaggatgaagccgcagcccgccggcttggaattaatagcattccgtactttatcattgacggagaatatgcggtgtccggagcgcaggatgaacagtactttttaacagccataaaaaaggcctatgccaaaaaataaccatagaaatggggaatatctgactgaagcttgcggaacacaggatattacctcatcagaatccgcccttacaggcaaacgaaaaataccgccagccgatcattggctggcggtaaaaaatcccttaattgttcagattccatttggcggcaatgatattataattgtttttcagccgttcattatggggatcatattgaagggcactctttgcatgttccagggattccttcgtcatgcccagccaaaaggcagctatggagcaataatcatccggggtatagtcccaggaataccccatattgacaaaagtttttgatttctcttttatttttaaagcttcttttgtcaggaaatacgtcattgaccagtcttttaattcatagcacattttagaaaactccacatagtggtcgcgtatatcaggcacttctgcaatggctttataataccaggcgtatgcctctttcaaataccctgttttatagcaggattttgcaatccagcgcattgcggcacatctttcatcgctccatacggcagaaggcattgcaagatattccttaagggtctcaatgcatttcttccattggctcttgtacatatattctctgccaagataataccgcattctctcatcctccggagcctcctctactgcaagctccaaaaggggaagataagaaccgcgggatttatctgggtcagggtaatgactgagaaccatgccctcaatatatatggtttcaacgggcagtttttctgtgtattggagaaattcatgaacagggcatttccagcggaagcccatccggctatgcactttaaaataataaaattgtatatcaggagtcccgtcttccttaaggctccagttataaagatatctgccccattttgcggccggcatgggatttttcggcttatgattaagccatgcctcctccagcttgttccgccagcccggctcaaataactcatccaagtccgtacaaacgcagatgtctgcatcttccggaacatgatccagtgaaatattccgtgccacatcaaaccgccagggcttcactatatccacatatacaaccgcccacgttctctcagtttctcaacggtcccatcctcggagccggtatccgtgactacaatcaaatcagcctcactcatggagtccatccacttatctacaaattgtacctcatttttgcaaattgcataaacacaaatttttagtttcatgagtgtccctccgctttttcctgttttttgatcttatcttcaaccgtcaacagattattctgcagccttttgttatcaggggccatgctcagggccttccgggcatactctccggctttctcatacatgcccatattataagcgctgatggagctgtaatcatataaggcatatccccagctctccggatcaaccagatagcttcctgtgctttccgtgatagctaatcccttttccgccatggcataaaccaagggccagtttttttccttgtaacctgatttcaccagagcaagatatggttcccttacatccgggcattctgccagcgcccggaagagccataatctggcctcttttaaatttcctttttcttcataacatttggcaataaaacgcatagacgcactgcgttcctcattccatttagctgttggaatggaaaggtgcttcttcagtgtttcaattcccttgtcataatttttataatacacatactctcttccaagccagaacgttgccctgtcatcaaggggattctcctgaaccgacaattccaaaaggggaagatattggcttcttggttttgacaaatccggataatgatttaagacaagccccttgatccatgtgattttttcaaggcccggtccgctgtattccaggatctcatgaaccggatgcacccaacggtagccatggcggctatggattttttccatgggatactgcttttgtggtgtgccgtcagggttgcaggcaaatgtaaataaatatcgtgcgcgggtttgttccggtttccataagtcttccagcttctgccgccatccaggctcaaaaacctcgtctaagtcattggaaacacagatatcagcatcctcggggacatgacttaatgccacattgcgggcagtgtcaaacctccacggcgatatggtctcttcataaacgatggctcctctttcccgaagcctttcaactgtatgatcggttgagcctgtatccgttacaatgactgcatcggcttcagatacggcatccatccagcgatccacaaactgttcttcgtttttactgattgcatatacgcaaattttatattggttcacttccaccgactcctttaagcataattaatcgtcttattttattctactgattcaatatatgcatcctgcagcttatcttgtgaagaaacggccttcaggagccattggagcggcgcagccttaatctttatttcatggaaggatccttatttggggccaatggttttctgccagcttcacaacggaagcaaagtattttcaaataatttcttccactgcctgtttccaatacttttccgggacattgggccatatacaatttccggtttcatcattgcataatgacattgccctttccagcaccatactatgtgatacatttccctttcgcaataaattttcagtaaccatacaccaatagggcgcatggttatccagccctgatgtatgaatctcttttattgcactttccagatcatattccaggctgacaaattcctctttccactgattgtccacttcatgcaaaagcagaaactgcgattttcccccactatacatgggaagcccaacagatcctgcattcaatacaatttttcctttgttctcaattttaccctggatatgtgtatgaccgcataatataagagatgaatccatcctttccatgatctcaaatgttttctcatcgtctggtaacagcttttgatttgttttgtaaggcgagccatgacatatcgttatctgtggcatatttcctatggtaatattctgggatattggcaactctttaaaaaaatccatgtctctttcggacaaatgtttatacgcatacagcaagcaaccagttgtcgaatcgttgtccaacggtacaaaccggttattttgataatttatccaataatcttctttatttcccttgatgaaataacattcataatcagcagacagctcataaattttcttcatggttttatccggataggccaattcaccaacataatcgcccagaaaaataaatgtttttataccctttgataatacatgctcaatgcacctttccaatgcaatgtagttgctgtgaatatccgataaaactgcaacagccatatcccgctccccctgaatccctgtttttacatggtataaataattcatatttccatggatcatgatttttaacgatcaaaacgaaaagactcactaatttcttaaatttacttaatcttacgaacaaaacgtttttttgttcttgttttaataattacgaatatttattatactctccgatcggaaaaggattctctaatcccaacactctcggccataggcctgtgccgtcaataataaaacccatgatcattcccatatggctatgtaaatgcctgaactgggccaaaatcaaagtgaaacgattgtattcacaatcaggcggagtacccaacagctgattatccgttaactgcgaaagataagtttttatttttatatcaataccggcaaaataatgatttatttcttcccttgaaagatgtttgcctgggcgtacttccaggttgtttagatcaaacaatattaatttctcagcttcttcattacatgatagcacaggtaatggccgttttccgttttaagcctatgatattccacagggatataccctctgtgaacatacattccataagcaggcagagaggcatctaatacgatctgggaatgatggttgaaaatgattctttccagttcatccattatggccgttccgaatccattgccctgatattggggtaatacaaacagtctgcttatttcatttccattgatgcttccggtaccgatgattctgtcatcatcctggatcaggtacacccctccgtccataatggcttttttaatcccctcatcagaatggtggcaaagaaaaaaatcaacggctcctttgggataataatcaggatataccgtctcaattgtagttttcactataaattttaccgtatgaaaatgcttaaccgaggcttttatcagcttcattgaaggctcctgtcatagatcaatttgcattttatattttattaatgatgatttcatgagaaataccatggaaactttgcttaatacgcctgacttagggttttgcccgtaaattgactttaaatgaaacgtgagggaatcttgtatattttcataaagaaaatatggatttaatatctctccataactttttagaaacagcattgatgatcaactcttctactgctgaaacgcttgcaataaaacaaacgaaaatagttgttgtgtataatcctaatccaatatataaaaacgggaaacaaaacaaagcgatccctgttgctttattcgcatacgtatgcaaaaaggccggctgcctgtatcgtataaaaccaatgaccaaagatgccaggcggatgaccgcaataataatgatccaataaatgccccacaaaggcaattgaaagcggggaacaaataagaacaacaaagccgcagccataaaaacatctgcaatgctatccagaatctgaccctttttgcttaccatattcattttccgggcaatgatcccgtctaaaacatcactgagaccgcacaaaaaatatacaataaaaaattgacctgaaaatggtgtcaggaccagcaaaaccgcagttcctaatattcttgatatggtgattaagttgggaatgttcttcatttgaacctccagcattttaataaaaccaaatctcttcacagattccttttctccctgccgtctgaagccggcatgacaccggctcctgcggcagtctttggctgcgctttaacctttattccgcatcaacgccatataccacttcataaatttccttcttatatggcttaaactcctcctcggtgacaggctttccatagctcatgatccacaatgggatgggtctgtccccaggctttaaaggcatctgctcatagtaaaaggtgttggtgtgaaatcccagcctgccgtaaaatccggctctgcttctggtcatagggtccttctctgtgattggctctatttccaaaaacacaggttttttcccttctctcatgacctcctgtaccagctgttttccatacccttttcccctgcatgcttccgttgttgccagatgctccaaaaagacacaggagggaagatcccagtatcccagaaacgccagaatctttccttcctcttctataactcggactccataacagggatcaccgaaaacccttttctgatcgtctttggtccggcgctcaatgtcaggaaatgattccttgtaaattcggtatatttcctcaaaacgggtctgcgggttctttaacaacataatatcaatctcctaatcctttatctatacttgtttctgtctatcagtgtatcatcctccttcaaaagaagcaatggaaaagcctgccctcgttaccgggcaggctgcatttcttttatctcattatttaatggtgattctgccctgacctgcaggatttgcataatcagcgcctacattgccgcctaagttgctgcggatataagcggaaagcagatccacatcagccagaacatcatcaaggattaccttgcttcccttaaacatggtcattccgtcgccgcctgactttaacatgtaattatgagaggctacggtataagtcttgttcacatcaagaggagcgccgcccaccatgatatcagttacccggtatgctccggtcacttttataaaattacccttttcatctacctccacgttgggtgccttggaggtatcaatggtataggtaattccggatacctgaaggaaaccgccgttttccttcgggcagttacgggaagccatttccagggcatccttgatctgctggccggttgcttccacaacgcagcccatgttgccgaatgggaatacggtaagggtatcattataagtaatgttgccggcctttatgctggctcttacaccgccgccgttggaaaggccgatatctgctccaagcacataacggtatgcatcggcgcacaagtccccaaggtttgtctcagcacttctgaccgcacgttcccctgttgccgggtcattgaccgtaagctctacatccgtatgtccgatcacagtctttaaggtctcattgtactgggcctgaattgcctttataaacatatctgtatcatagtcaacagcctttccgtcagccgttacagcactctttcccggaattaccagctggattcccacagtaaggacatttggatctttgatcttgtccctgtttgcttcataaatttccttccagcggttataagatcctaattctctctttgcgatcctgcttaaggaatcaccgctttttactgtatatgcgctggtgcctgctcctgccggaacctgggaaatcagttcgctggtaatggttccgtcggtgcggagtgtcagctttccgatgttctctaactttgttcctgtctgggtgagaagcacgtcctggccatccttattttttacgtactttccatatgcttcatgggaatggccgtcaatcaacacatcaatgccggtggtattcttgatcacgctgtcagaggtccaacggtctgttgtgccgttttcgcctaaatggcctaccaaaatcacataagcagccccttctgccttggcgctgtctaccgatgactggatctgtgtatagagtttttgtccgctttcatcttcacaaaagccgtaaatgtaatttccgtttccatcctggaaataagccggtgtggatttggtaaagctttccggcgtggttgctcccacaaacgcgaccttcgtatctccgtatgtaaaaatcttataaggtgcaaatactgcggagcctgtccttaaatccatgaaattgctggaatagtagccgcagcttaactttcctgccagttccagaaaacggggcatcccatagtcaaactcatggttgcccggcaccgcaaagtcataaccgactttgttcataatatcaatcagatatcctccgtctgacagagttccgatcggcgcgccctgaatggcatctccattatcaaccagagttacataaggagtctgggcctgcatctcttttttatagagagcaagtcccgcatatcctatgttgccgtcgactccgcaatggacatcattggtgtagagaaccacgatatcctggtctgccgccagagacgaaaaggatatgcccgttgtcagggatatgaccatgagcagagccagccatagtgacagaaaccttcttttcttactacctatcatttttaataccctccttttgaaaatacatttttctctattatatcagataaatgtaaaatcagcatataattttttcgatattttttagttgtttcttcactttatcaggctcttttattggtttaatcgacataaatacaaaaaaaggatgtccatccgccttaaactgacattttaggcagagagacatccctcatgactcatttattccgtttcttcactgatttctattcccagctccacaagctgttttggatccacatctgcaggagcttctgtcataaggcaggaagcgtcttttacctttgggaatgcaattacatccctgatgctgtctgcgcctaccatcagcatgaccacccggtccaggccgtaagcaagtcctgcgtgaggcggaacgccgtatttaaacgcatctaagaggaaaccgaactgatccttagcctgttcctttgtaaagcccagcacttcaaacatcctggactggatatcactctgatggatacggacagaaccgccgcccagctctgttccgtttaacacgatatcatatgcctttgcacggacagcgcccggatcgctgtcaataagcgcccagtcttcatccattggcatggtaaatgggtggtgcatggcggtaaagcgttcctgctcctcggaatactccagcagcgggaattccgttacccataagaacttaaagttatcctttttcagaagatcaagctgtcttgccagctccagccttaagttgcctaatacgtcaaataccaccttgtcacggtctgctgcgaataaaagcaagtctcccggctttgctcccattgcctccgccagaacgtgaagctcttcctctgtcatgaattttgcaaaggagcatttataggttccgtcctcatttacagccagataagccaggccctttgctccaaagccttttgcgtattctaccaggccatcgattttcttacggggcatggctccctgtccttcggcattgatgccccggacagaaccgccgttttccaatgctcctttgaatacagcaaattccgtatcctttaccacctcagaaacatttttaagctccatcccgaaacgcatatccggcttgtcggaaccaaagcggtccatggcttctctccaggtcattctggtaagaggaagctggacatcaaaattgcagatatctttaaataatttctttatcagcctttcattgacctccagcacatcctctacatccacaaaggacagctccatgtcgatctgggtaaattccggctgcctgtcggcacgtaaatcctcatcacggtagcatctggctaactggaaataccggtcatagccggaacacatgagcagctgcttaaaaagctggggagactggggaagtgcataaaaagagcctgggtggacacggcttggaaccagataatccctggcgccttccggcgtgctcttaatgagggtcggtgtttcgatctccaaaaatccctcttccgctaaaaatgctctagttaaggtagcgacctgacttctcactctgatgtttctctggatatccggtcttctaagatctaaataacggtattttaaccgcagttcttcctttgtcttgctgttctcttcaatgggaaagggaggtgtttcagattcggaaaggatcctcaagctctttgcccgcacttcaatttcacctgttgccaggttctcgttaacgccgcctgctcttgtttccacttcacctgtcaccgcgatgacaaactcactccttaatttctcagcctttgcaaagctttccgctccgcagtcgctttcctcaaaaatgatctgcaggatcccggaacggtctcttaaatcaacgaaaatgatccctcccttattcctgcttttctgaacccagcccataatcgtgacttcactgcccacattggcttttgtaacctctgtacatctatgggatctttttaagcctaacattgattctgccataatttcctctttcctgcccatacttttgggcgttcctcctatctgtttacttaagcgtgtctttatagaattccttaaatattgtatatccttccttctgaaggctttctttctgaaattttttatttttattcatctgggaaacaagaacggtcacaccttttgcccgttcttccatagcctctttgatggctccgttcatcacatcaccgcccgcgcccttttcaatcaggaatgccaccttgtcttcttttcctggaaccgtgaagccttcctccatcaggatggtgatgatacgctcaaatccaatggaaaagccgcaggcaggtgtatccatgccggtgaactttccgatcatcttatcgtaacggccgccgccgcctacagagcctgggaaaccgtctacctggatctcaaaaatggttccggtgtaataggacatccctctcaccaaagtaggatcaaagacgatgtggaactggctggtggagatctggcccacgctgtcaataatcgccgccaggttctctgcccgctcctgatccatcacatcctttaaggtcgcgcccaggtcgcggactccggcagcatccggagttgacgcttcaaaaagggataaatactttttgatattttcctcgtcataccctgcttccgccagctcctttgcaacgccttcgcttccgatcttgtccattttatccagaatgataaacacctggtcataagcctcttccgggaagccgcagaaagcagccattccctttaaaatattccggtcgttgatccttacggtatatcccttaaagccgatctttccaagcaaagtggtggtggcaaggatgagttcgatctccgcaagcctggtggaatctcccaggatgtcgatatcgcactggacaaactgtctgaaacgtcccttctggggacggtccgctctccatacacttcccatctgaagggatttaaagggcgcaggaagagacgccgcattgttggaataatatctggataagggaacggtcaaatcataccggagaccgctgtcaaccagatcattttccgcctgtgctgtctccagattcagcttttctccccgcttcatgattttgaagatcagcttttcattgtccccgccctgtttgctggtcaggttctcgatgtgctccacgcagggagtctcgatggaatgaaagccgaagccgccataggtttcacgtatctggttcataacatattcccgcacctgcatctcggcaggaagaatatccttcattccggtaaccggtttcttttttaatgccatttcgttcactccgttattttcttaattttgtagggaagtccatcgggtttccttaaacaaatcatgcctctattgtaaattacatttccaattttgcaagcattttttcttttctttccagcatttcgtcgattcttgcaatatactgttccacatctttgacattttccacccgttccagacggttttcagagggaaataccaccttggtggtggttcctgccccgcaggcagcaatggtctgcttttcttccatgatcaaaatattatagatacaggctttgcctggaagggaatagcccacgttttcaaaattgcctgccatgttcttctggcggtacagataatatggctcctgtcccatgcccctggcataggctgcagttaaatcgatcatttcctgagtattggtgatctttagatccccgtactgttccttaaacatgtttaagcgggccgcacgcttaatggcaagagaatggacggtgatcccatccggccccagggccttaatttcctccatggtgcgggtcacatcctccatatcctcttccggcaggccgatgatcaagtccatgttgatattgtcaaagcctaaggacctggccatggaataccggtcctttaccatatccacggtgtggcggcggccgatgagatccagggtttcctgcttcatggtctgaggattaatggatatgcgtgtcacgccgtgggcttttaaaacctgaagcttttctatggtaatgctgtccgggcgtcctgcttccacagtaaactccttgacccaggtaaaatcaaaggtggttttcagtctgcttatgagtttatctaaatgagcaggggaaagggaagtaggcgtacctccgccgatgtagaccgtatccagggtccttcctgccattttccctgcagtataatccatttccttaaataatgcttccagatactgttccatacgcttttcccattgtccgatgggaaaggaagtaaaggagcagtaaaggcaagtggttgggcaaaagggaatgcctatatataagctgtagccgcagctgtaatcaatggcagaaatgagtttcatctcccgcacggcaatctccaggctcaaatccactttttcatcactggtcaaataagtatccttcatgtatctgcggacttcattttccgaatatccttcagaaagttttgtcatggctattttggtcggccggatgcctgttaaagtcccccagggcagagagttctccgtaagctcccggaccatgccgtaaagcatccgcttgatccggttcttggtatcaaagcggtcggaaaaatccacctgggcggaggctgaccttgtgatccctctctcaaaatcccggatagtcagctgaaaggcagcttcccctgtctctccccgcacaagaaggcggcaggcttcctcctggatttctttatggacaaagctctctccgggataaaaggccatcaaaagctccctgatatcctgttcaaaggattggtcgtctaatattaatcctatcatgtcttttcctcttaatgcttccttcctatcctctgtataatgctgccggattatgcaccttctcatgaccgatggtggtcacacccccatgacccggataaaccatggtatcctccggcagtgcaaaaagccgttccctgatggagcttaagatcatggactgatttcccgtaggaaagtctgttcttcccaaggaccttaaaaagagagtatccccgctgatcagaacgctttccggttggaccagataacagaccgaacctgaggtatggccgggggtaaacaaaacctgaaaggtgattcctccaatggagaggctggctccatcctctgcatattcgtctgcactgaccgtgcaggccctgccaaaagaagaggacaaattaacggcaggatcttccagcagccctttttcctgctgtccggcataaatcttcacctcaggaaatgcctcttttatatctttcacagccagaatgtggtcaaagtgaccatgggtcagtaaaatagcctccggtgccagggaaagctccctgcacatgtccaggatataggccccgtctccgcccgggtccacgatcaccgcttttttaagtgactcccggtacatcacatagcagttggtcccaagctggcctacctggtaagcctttattctgaaatcactcataacttgcctcctaatgaatttatccggatccggttcagacaaagagaaaactgcgttatcccgcagtcctctcaatgtctatgaccccttcgatttgtctcagcttatcgaccagctttcccagctcttccacgccatgggtatcaaaggtcatggtaatggtcgccttgccctgcttgttggtcctggagttcatggaggttatgtcgatctgcctctctgtgaaaaccttggatatgtcaacaaacatgccgatcctgttatttgcaaatatcttgatttccgtggaataccgctccttggtgtcgtctccctccgcctgctgccattccgcgtcaatgagacggttccgttcgtcctccggcagatttaagacgttgatgcagtctgtcctgtggatagaaattccccgtcccctggtcacaaagccaacgatttcatctcctggcaccgggctgcagcatttggaaaaacgaaccgcaagatcatggattccctttacaacgattccgctgccggaacgcctcttcacaggcagcctgctgctcatgtcctcaatatcatttaaaatgctgttgtccgtaacgtccttcttaagcttcttattccgttcatccaccatcttattgatgacctgaccctcttttaggcccccgtgtccgatggatgcaaggacggattcccagtcgcggaaggcatagcgtttcatgaccttttcctggtactccggcttgttgatttcaggataattgatcccctttgtcttgcagtagcggtccaccatttccttgccgcgaaggatgttatcttctttcagctcggttttaaaccactgattgatcttattcttggcctgggtgctcttcaccatattcagccagtcccggctggggcccctgctgttctgggaggtgatgacctccacctggtcaccgttctcgatcacgtattcaatattcactaattttccgttgaccctggctcccaccatcttgttgccgactgcactgtggatggagtatgcaaaatcaatgggtgtggaaccgacgggaagatttttcacatctccagagggagtaaagcagtaaacactgtcagagaacagatccaaatcaccctttaccatattcaggaattctttgttatcggacatgtccttctgccattccagaatctgacgcagccagctcaacttctcttcttccttgccagccgccacctgtccgcttccgctttccttatacttccagtgagctgcgataccgtattctgcggtacggtgcatttcataagtacggatctgtatctcaaagggctgcccgttgtttccaatgagtgtggtatgaagggactggtacatattgggctttggcattgcgatataatccttgaaacggcccggaatgggcttatacatctcatggatcaccccaagggcagcgtaacagtcctttacactgtccacgatgatacgcaccgcaaataggtcgtaaatctggtccagggtcttgttctggttcaccattttcttataaatgctgaaaaagtgctttacacggccatccaccctggcttcaatcccgccggtttttaagtggtcctgtacctcatccacaatactctttacaaatgtttcccttgcatcctttttcagtgatattttttccgccagctcgtaatagatctccggctgcagatatcttaaagacagatcatcaagctcgatcttgatcttggaaataccaaggcggtgggcaattggagcatagatttccatggtctcctttgccttttccttctgtttttccggtttcatgtactgaagcgtccgcatgttgtggagccggtccgccagcttgatgataatcacgcggatatcctttgccatggctaagaacattttccgtaagttctcggcctgtatctccatcttatccatggaccaggatatctgggtcagttttgtgacgccatcaactaaaagggccacctcttccccgaattcccctttcagctcatccagggacataatggtgtcctctaccacatcatgaaggatcccggcggcaatggtctccttatccatttctaaatcagcaagaataatggcaacacaaagagggtgaatgatataaggttcacccgatttgcgcctttggtccttatgcgcttcatccgcaatatgatatgctttttctatcatggaaatatcatcggaagggtgatatctccttatactgtggaccagctcttcataaagcgcgtccgggctggtaaaatcagccggagcttccaggtcaatatccaccttccgcttctccgggcgctctttttccaaagcttctatattattcttttccattttaggattatctgccatttgccgtcacctttttttgtagcattcctggttttcacctgcttttaaacgtagttatcattcattataattattattgtcgaaaaatgcaattattttttctttttctccttcttccaagaaggcgctttccagggcgtaccggttcatctgtcttagatctgcctcagtaaagcccatgtatttcttaatgagttctgcttccttttccagtgttgtatctgaaacagtcatattatccgtgttataggtaacccggattcccctgtcataaaaggcctttaacggatgctcctctatggagggaactgcctttgtctgaaggttgctgacaacacacatctctaaggtaatcttttccttttttaaaaggtccatacatgcctccgaccggattgctgcacatccgtgcccaatcctttttgccccgtaatggaccgcctttatgatattttcataatcaccgcactctcccgcgtggatggtaaatggaattcccttccgcccggccgccttaaaaagaggctcaaaatgttccatggggatcagcccttccggacctgcaagatccagacccacaacgccctttccaagataagcccgggccagttcaaaggtctcctcattttcccggtcagacccgttgaccatagagcatagaaggatccctgcttttatccgggacttgcctgcgcctctctttacgcctcttatgaccgcttccaccgccttttcctttgtcagaccctttcccatatgaagctggggagcaaagcggatctcacttaagattagcccctgggaagccaaacgctccgttaaatcacaggaagccagttccagggcttcttctgtctgaagcagcatccccggtaaatcaaagcattttaaataatccaccaggctctcacagttttctcctgcaaccaggctttcccttccgccctgtccttcaaaatcatatccgatctgggccgcaagcagctttaccgtatcaatggataaagagccgtccaaatggagatgaaggtctgtttccaatcgtttcataacgatccctccttctgttgatgaaaacattttatcatactacgcagaaagtaacaattatttcataacatacttccgccccttgttacctcatttaggatcaacataaagaatgtttatatagtacgggaaaatatccagaatgtgacgatacgcgttaagattctttgcagatacggacggatttattatgagtcagaaaaggccggaataatattctattgattcaccttctcttttttactgaaaatcaaaagcttctgtaccagaaagtttccaataaacataccggcctccactgcggctttggccgcccagccattgattcctttgcttttcaccaaccatacaagcaggacggtattcaccagcaaaaccgctgatgccagcaccgcgtattttaccgcaaagcggctggagactccctgcgcttcaaacacataccgtctgttcagatgataatttagaactgcacttcccatacgtgccaaaacattgcagaccgcttccgcaaaagacagatgaagtgctgcggctgcataaagcataagactgtaaatcagaaagtctgcacaaaagcttataaatgaagaagctgcaaatttcagcaggtccacataaattctcaccgaatcgtttaatacccggaaatgagaagacttgtttccatctaaataaacggtttcaacaggaacttccataacatcaattttctcctttacacacatcagcaatacattggtttcgtattcgtaccgttcaccaggaactgctaaaagcctgggaatcatgccgctgtcaaaagcccgcagacctgtctgggtatcctttagccatttccctgacaaaatccggaacacttcccttgtgatcttatttcccaatctgcttttcaaggggatgttcccgtgaaagctgcggcttccaagcaaaagagagtctttattctcagtgcctttctttaataaataaagaatgtcatggactttgtgctgaccgtctgcatctgcaatgacaatttcacctttctgatcctgctccattatgtattccagcgccgtttttactgcctttcctttgccgtaattccggtcatggctcaacacggtggcataggactcacactccagaaaaaaaccttctgactccctgctgcttccatcatttaccacaaacagctttgcatcagacttcttacacagttcttttatcagctgtatcagccgttcatccggttcatatgcaggtataataatcttgcccttctcttctttcatgatcttcctcttttattttacttttaaccgcagtatacctgccgtcactgaaatgttcctgaaaaatccaaggataaattcatataaatatttcagttctttttaagtaacgtgcgctataatcaaccccatcagatatatcctatctgaaatcaaaatcttgaaaggtgtgaaaagcttgagaaagaatggaaaaaacttgttatgtgctggcatctgcatcctggctctcaccggctgcagcatgaacagctatgctaccaccgcggcggcagcccagactgaaaagcaacaggagcagcctccaaaagacaccggcatcctggctaaaatcacttccgttgataaccggaccataacggtaattcttgcagacaaaggggaaaaaccagacggtgccccggatcaggatagcaggaataacggcacggctccgccggaaaaatctgcagatggaataactcccctgaaaaacctgcagatggaatgacccttcctgaaaaaccagaggaaaatgcctcccttcctgaaaagccggcagataacagcgggcaggcaggttccgcagaaagggaaaaaaggaaactggaaatgaactttgacggggaagccaaaacctacaccattcctgattctgctgtcattacgaaaggcatggaacaagaaagtgcatctgtttctgatctgaccgtagacactgtggttcgcattacattggatggagatactgtttccggtatcagcatcatgaattaaccgtattccgcctgcatgcattctgcaggcggtccttcctgaccaaatcttttgaaaataaccggctgactgaatgacttcgtacattcctgtttcgccgggtcctgcagatctaaacctgacattggcacgagatgtttacttagaggatatttctcatgaataaaaaaagatttataaaatatatattgatcgatttcctttcggctcttcttttgatttttatctttctcctgtacttttacattcttccgcgcaaagaagacaacaccggcaggaacatggtcagcgaggaatcggcagaaaaacagacttttgaactgcctgaatcccaggatcaaacctctcctaaaaaaggaaggtcccgccgggaaagcggcaataccgacacaaaatccattgcctcagaaaacagcagcttagtgtttaccgataaagcagatacggttctggcagaatacaaaaataatggcctgcagctaaatatcgtaaaaagtgaactgggagaagggaatgataagatcacatattacaccgcagatatttatctttcttccaccgggcagctgaaaacagcttttgcccaaggagtttttggcaaaaacttaagggaatccacacttcaaatggcagaggacaacaacgcaatgctggccatatcaggtgattcttacggaaataatgagacaggaattgtaataagaaacgggatcctataccgttcagataccaatgacgcagaaatatgtatcttattcctggatggaaccatgaaaatttatacaccggaggaatttgatcaggaacagattatggaatcggatgtatggcaggcctggaactttgggccttccttattgaatcaaggcaatgtcagggattccttccagaccacctcttatttaaacaacaggaatccccggtgcgccattggttatgtttcaccgggacattataaattcgtacttgtggatggccgcaatcccggatattccaagggcgctaccatgagtgagctggcgcagattatggcctatgagaattgtactcttgcctataatctggacggaggcaaatcctctgccatggtatatcagggtaattacataaatcaaccggcagacggaggacgttccatcagcgatatcatctacattagaaaggaagcttccatacaatgaaaagatggcatacattcctatggcctcatttgacccttatacttgccctgtttatgggcacgctttgggtcttagaccagctgaatcccagaatgaattttctgaataatgatattacagatgtgattttcattcttttttgcatctcatccctgatcacctccgcctcattcctctggcagaggtgcagaaatgagaaagaattattttaaacgcgccctatgcagcctcatagaattatcctttttacagccgcactgttttcagcagcggaaccaccgcctcaaaggattgcctgctgtattcatatgcagctattttatcgacttcatcaccgacttcatccagatcatagggattccggaacgctgccataaccatggggatctctaatttttccagttcttttgcaaggacactctgtccacggtttaaatgcccgttgtaggtgcccagcacaaggtccgtatatcctttactttttactttttccagtattccgtttatctccccggtatccggatctatggaaaatgaataggaatctcctccaaacctttcctgcataaatgaggcaaacagcagatcctccattacacggctggaggccagtgtggaacgataagcataacagcttaaaaatacaggattttctcccagcagatggcaataaccttttccccggttggtaaaccgtatgctgtcacgatacagtgactttacaaacttacccggatccttctgggatttctttccaatatctgtattggttgacccatatcttcttttatatgccaggatccgttccacggcatcgtcaatccgggacatggggatctcaccggattccaccgccttttctatttcccttgccgcttctgccgcaagatccgccgtatgggaaatgaataggagatcaactcctgccataatggcctttttagcccccaacgcagtaccaaaatattctttgatggcattcatttccaggcagtctgaaatcaccagtccctgaaagcccagcctgtttcttaaaattccctggatcatggtttccgacatggttaccggtaaattttctttttcaattcttggaaacagaatgtgggcaagggtcacagccgcagctccatgccggaatgcctctttaaacggaatcagttcttcctgttccagctcctcataggatttttggatgcagggcagggaaagatgggaatccactgccgtatccccgtgtcccggaaaatgctttacagagcacatgatcccggaatccagataccctttcaccatctcacagccgtattcagtcaccacggcactgtccggtccaaagcttcgcacaccgatcaccggattgtggggattgttattgatgtccagaaccggagcaagattgaaattgatccccagctctcttaattcctgtccggtaaggagtgccgcctcgtatgcatgttccttatccccggtctgtgcaagagccattgctcccggtatattgaccgatccttccggaagtcttcttactactcccccctcctggtcaatggtaataaaggcatactctcctgtttcttcctttatcagcctttgaatggagtcacaaagtcccttcagctggtctctgctttcaatgttatgggaaaataagataacgtttcccacttgatgctctcttaccaggcgtatcatatctttacttaattccccggcaggaaaaccggctacgatcatctgtccgatcttttgttttaatgtcttttccctcatgctcctttcccccctttcatttatatagatgaaatgcttttttgcgttcagaaaatgctgccgcatccctttcaaattcagccagcagttcctcttttgaagctgttttccctgtcagctgatccgatcctaacaaaagatcttccattggcctggtgcttccctcatgaggatcaagaaatgcaaagctgtcttcataaatggtccggatggcatcaagaagctccaatccgcaaagcgcggaacggaaagcccggctgtccgtaacgtgaatatggattccctcacaggcttctcccttaaactttgaaaaatacggagtgaaataggccggagaaaacaatacgccgggaagctttttctttgtcatatatttcacaagctttcctgcttctataaatggcgcgccgatgatttcaaaaggcgccgcagttccccttccctctgaaatatttgttccttcaaaaaggcaggcacctgcatacacaagggcagtctcatatcttggcattgccggactgggcatcacccacacatgaccggtttccggatgcatggcatgccggttccagccctcacagggaattaccgtgagccggcagccaaggtttttctctccatttaccataagggccagttctcctaccgtaaggccatagcgcatgcaaagaggatatgctcctataaagctttcaaatccgggctttaagcagttgccctccaccaaatcccccagaggattgcagcggtccaggataataagctccttgtcaaaccttgcgcaatcttccagtgcatagatcatggttgatatataggtataatatctgacccctaaatcctgaatgtcatatacaacggcatccacctgatctaacatttccctggtcagcctttttgaatttctccggtacaggctgtataccggcaatccggtatccggatccatgtaatcctctacatcgccgcctgctcctatatttcccctgactccgtgctccggcccaaataaggccgtcagccgatattttttatgtaaaatgtccacagcagaattcaaatcactgtcaacgcctgaaacagaagtgatcaggcccaggcgttttccgcctaagaccttatgccagcggtccacacaatcgatcccgttttttaccatattgtccctctttataattccggtaatatcacctttttttgttcctgatccacatcaaaggcctccgcatatccggttcttgccagacagccgtttaccctcatgagatgctcataatactctttataagggaaagaaggactgtgtattgcaaaccaatgggtgtcaatggcctttttccacagttcaaatccttcttttgatacttccagataaatatatttttcaaatcctgccgagtcttcccaattttccgcataatagggtccttttgcaaaaaaagcgctgttttttctttcaagtccgggaagtcctgcaaaaaactgagcatcctttacgatcctgtgggttgtttcatgatctttgtgcatgctgttcttccaatgggtcagcaatgcagccggccggtattgccgtatggtatcgcaaagctgaagccttacctcctcattatccggcaattctccgtctgtgtaaggaaatatcaccgcctcccctcccagcatttgggcaaaggaattggcttccctttctttttgtattctgtattcttttaccggcatgccaggcgggttccctctttccccgccggtcaatgctacggtaacgatatgatagccttttaatgccatggtcgccagaaatccgccgcttgtcagctccgcatctcctacatggccgcctattgccatgatgcactttctttccccgctcatccgtccttccattcctttctcatatcagcccaggtccttacgatccgaaagcctgccgcctcataaatatttcttgcgggattattttccccggtaaaaaggctcataaaacctgctcctatttccttcaagcttatgcaaagcctgcaaaacaggaccgttgatatttttttaccccggtaatccggatccacaccgattccgcaaaaatatcctctcccgctcttttccacatccagtggtcctgtaaagccgatcactttgccattgtgggctgcaatcagaatgggacggctcttttctccctttgccgtttcccccagaatctctctctcccacagtggattcctgaacttatgtatcatttcttccattccgtaatgcctgtcagcatcatatatttcaatggtaatattctctttctccagcccctctgtgatggttgccgcaaaatccggcacagcataagcatctaagtccaggtaatagctgttctgcatggcataatcccggtacctgcaatttttaaagaaaagataggcattgctccctacatccacgcccggagcattgggatgatctgccgtctttttcccgggaatataccaggaaaaagtcatagggttaaaaaaaacaatttctatctttgaaactccgctttccttccgaagtctgtcttctaaataagcaagcatcgctcttccgatcccctgcctctgtttttccttttttacaagaatcatggaaagataggctctgtcctcacctctttgaaagcatccggatgcaaatccccggccttgttcctccagtatggtgattttatgtatttcctctgactggttttccataaaaaagcggcgaaaggcgctttggttttcaaatggccggaacaatacttcttttattctgaccgcatcttcaaataattcaaaggcggttcctgcattctcctcgttcaaatccaaaaaattcatatcactcactccttatggccgaaaaactgaggcagatattctttatgggcttccagcagctcagaaagcacggcctttgcttctttctgggagccaaccaggggattgatcataagtgccagcagagccttctcctgacttcctgacaccgccgcctggcagcctgctgtttcaaaggatttgatctgctgcaaaaggccgttaactgtccatggcagttccaccccgtctaccggaaccggcccatctttggtgatcctgcagctgacttccacgatctcatgatccttaaaattttttatggcacctctgtttaccgtgtttaccacctgaatatctcctttgtcattgtacatggaattgatcaggttacaggctgagtcgctgtaataggcaccgccccgctgtgacagcagttccggtttttcatttaattccgggtcctgatactgctcaaacagctttttttccacctgttccacaagctccgcccttgtctcatgtttttcatatttttccagggcttcttctaaatattcttttgccatatagtaatatctgtgataggaacatggcagcactccaagctcttttacaaaatcattgtcccaagtgactgcctttatattctttacaacgccgccttccccccaatggctgactaccttttccgtaatgtcttttccgtccgcttccactctggtcacgtaaaccatatgatttaaaccgcccatggtgactttcacctcttccatgggccggccaagctggtccgccaccgctttatgcatgccgtaaggtacattgcacagcccaataaacttctgaaaactgctgtatcggcttactccttccatgaccattcccaccggatttgtaaagttgatcagccatgcttccggacataattcctccatatccttgcagatatccaaaataaccggtatggttctcattcccttaaacaaaccgcctgcgccattggtctcctgaccaagaagcccgtgctttaagggggtcctttcgtctttcactctggcctggagctgccccacccgcagctgggtgaccacaaaatcagctcctggaagggcctttctcctgtccagggttgtgtggatctccattggaactcccgccttttttaccatgcgctttgcaaattcggctacaatccgtaatttttcctctccctgaaggatatccaccagccacagctcttctaccggcaatgtctcatacctttttaaaaatccgtccaccagctccggtgtgtaactggaacctcctccgattgccacgatcttcacaccttttttcatgactgaacgcctccttctttgctttgcagcaataaatacagggctcctattctccctgccatgtttccctgttcgcaggcctctatggccgtatatggctccaggtgaggatacagggcgtataccgcctctttcatatcttttataaatatctcattttcactgattcctccgccgatcagcaggacctcaggatccacggtgacagcaaaattaccgatcaccattgcccccttgtaaagccattcccggtatacccggtcaatatacgggtggttcaaatggctgaaaatataggatccgtccacttctctgcccagggcttccgatacctttctgaccagaagagaggttgctccggctccttccgcaaccggctttccgtccccatccctgaggctgactctggtaaacccgacctccccggatttaaagtggctgccccggtataatttccggtttatgatgatggcaccgccgatcccggtcccaaaggtgaccatggaaatatcctgatatccccgtcccgctccccgcaccatttctcccaatgcagcgcaattgctgtcattttcaagcaccaccggaatgggatattttttgtttatctcctcttttaaatgataggccctgaaattggctccaacgctgaaatctgtattttctcccgtcaccggatggataaagccgcccatgcagattgcaacgccgtctgtctgatccacataagtatccacgattcccataaactgccggagaaaatcaggcggctgtttttccgttggtgtgcttccttcatgaaggacccggtattccggatccataaggctgtacttgatgtaagtgcctcctatatcaattgccaggtactgtttcatatccgttcctttctgctgtctcccgtaatatgatcctgatggccccctgggcagcttcccctctcattttcatgatttccaaaaaaggaaatcgttttttcgccttttcacaaaacaggcggtatatatcgttatttttcatcaatacgcttccgctcaccaccagggagaccggagagttaaaatgagtcagtacggctccggccagctccgacagttcctccccgcattgctccaaaatttccatggaagcctgatccctttcccttactccttcttccagcaaaggagccagggcagcgatctcttttttgcttctcccgggctgatacagccaggtgatcaaatcctccacagaatctatcttaaggaattgaaatgttttttcctttaataaggtctccccctgtctgccatccgctgctctgaccactgattttaaaatatcccttccaatggcataagcacttccggcgtcgtcgatgatgtggccgtagccgccggccctaaacctggctcccgactcattgatcccgtaacagatggagccggtccctgcaatgagaatgatgccggcaggttcctccagggctcctgccaaagcagtttcatggtctcccaccagccggatcacgccctttagcccctgttcttttaaattccgggtcagaagctttgctgtatcccggttgctgattccggcagcgccaatacagatccctttgcagtcactcatattcaggcctgacttttccagttctctttttaactctttcaaagtgccttctgccgcttcccgggactgtccattgatatttaaaggccctaaccggaattttcctatcagatcaccgtgaagtccggtcaccattacggcagtggcggtaccgcccccatccattcctattacaaatagttctttcaactttatttcctccctttttcctttggttatcccttcactgcaccaaccgttactccttccagaaaatatttctgcaaggtaaagaacaggatgaacatgggcaatgccgagatggttgcccccgccatcatgggtgagaaataagtggtgtttgcaaaactgaaattcttaagcccaacctgtatggtctgcatctcctcgttgttgcagatgagaaacggccagaaaaacgtattccagctgcccataaaggtcatgatcgccataacggatagaattgtctttgaaatcggcatgactatttttatcaggatctgaaactgattgcagccttctgttcttgccgcttccagtatggaggtaggaagagaagaaaaaaactgtttcgccataaacacattgtagcaggtaaccagagacggcacgatcaatgcggtataagtatctgtcagcttcagcacattggccaccagtatgtacaacggaacctgggtgacctgatagggcaccatcatggaaaacagcagaagaaaaaataatactttactgcccggaaacctgatttttgcaaatgcatatcctgccattccggcaaagaccacattgcttaatgtgacagcccccgcaacgatcatggaatttacgatccatcggaacgagcttttgctgaatccaaaaaagaatttataggaagccaatgttaaatatttggggaccagagaataactggctgcccctgcctcatttggcgctccaaaggaagagatgatcatgtaataaatcggaaacagagtcagtatccccaggagaagcaggaaagctgccattacactgtttcttaacactaatttgtatttttgatcgtttccatattgtctgaataaacccatatcaaccttccttcctagtactctacgtcagcagccattaccttaaactggaagaccgcaaagaccgcaataattcccgctaataataatgcctgtgcacatgcctccccatagttaaaatatttgaaagcattgttaaaaatcagcaatccaaccattgttgtggcattatccggcccgcctcctgtcattaaatacgccgtctgaaaggcctgaaatgcattgatcactccggttatggccagaaagaccgtggtgggctttaccataggccatacaacgtatctgatcctctggagaaaggttgctccgtcaatattggctacctcataataggtgggatcgattccaagcaatgcggccacataaataatcacggtagatcctaagcctgagaatattgtcatgatgattaaggacagcatggccgtttgagagctgcccagccagttctgattctggatcccaaaggtccggatcaccgaatttaacagaccgcttggcagaggatcaaatatccacttccacacaaaggagagagcaactcccgatgcaattccaggtaaataaaataccgctttaaaaaatgactggcttcttttcttaaaaggaaccaacagaatggagatgatgaacgccactgagatggagataggcaccgttacggccgtatacaccaccgtgttccagatggatttgaagaaaagtccgttttttagtgtgttactgtaattggcaaatcccacaaactctgtttttaagggcttataggattgaaaacttacaatcgccgcctgtacaaccggatataatgtgaagataataaatgacacaatgggcacgaatacgaaaacatacccccatttgacatcattgttcaagcgctttctttttcttgctgtctgcatactcattcccttcttccttttttctaaaaaatataatatcctgcggataagaaatgggcattggcacctgttacgattaccaatgccccataaatcatgaaatcctgtggatcttatttcccgttaatccatgacacagccatcctcgccaaacgcctccactgcagcctttttaatggcttcgtgcatctgctccggagtaatttctcctgctaacaatccctggaatttgggcagaataacctcttcctcaatctttatggcctttgcccctaaatcagccgggatgtcaggtctggcttccgccacctgggaggcaagattcttaactgcttctgtattattcacatttttaccttcaatcggggtaagagaagcaaatgcttcctcccctgacttgcaaacgggactgatgtaaagctcctggcaggtctctgccgctctttttccgcttgacaggaaataagctgcctttgccacgttctttaaatgatccggatttggttcatccttgccgcggaagcacacatatccatctacggctccctgggcctgctgtttatttccctggaatgtgggaaccggcaatatgatgtattccacttcctggcttccttctactgcactgccgtcttttgcagccagctttttattattatcggaagcagatttttcaaagaccgacagtcccttgccggtgatcatggtctgaccggtcaggaacatgttccaccgtttccccgcatcaacggaacttaattccttcggcatggagccatcgtcgatcaaggctctgatatcttttaaaaacgggaccatctggctgctggtgtatgtatatttcaaatccttattaaatgcggcaggcattcctgcattttttacaaaaattgaaaaatagtccttagccgctacgcctgagcaggcaaaaacaaagccgtaccgggaataagtatccccgttctttacaacgccttttttaatggcttcccggaattcttcataggtccagccgtttttctgcacgctctgccagtcgattcccgcttcctccagcatagccttgtttccgccgatcgcctgcacctccacataggctggaaatccatacagaccgtctccgtttttaaaatagtttaaaatgtccttgttataatcatctatcatggtctggtcagcatcttgtgaaatatccaccagcatttccgtgtccagatatttggtgaccccggtcgagccgataaatgcgatatcaggcggagatcctgcgtttacctggacatccagtttttccgtaatgtcttcccagcttgccgttgtgatctgcagctctatatcaggattggcttcgttgaattcctttgcatattccaccagtttatcctgataggatgcggaaacaggcggcagcaatgccttaacaatgtcttttccattgctttgctgcgccaccgtgccctttgaggtatttccgcagcctgccagtgtgccggcgatgagggctgctgtcagcagtagggataattttctttttttcatgttttctcctccattatttttatatatgctctatggcataacgcacatgtccacgtgcctttaccaacttctcccgtgcttcctgggtcctgcatcccgataatatggatacaatcgctgtctttgcatggccgtctgaagatgtcagcgcctcctgcgcatccctccgcctgcagcccgtggcttccatgacgatgttttccgccctttttatcagttttgtatttgtctgtaccacatccaccatcaggttctgatatgctttgcctattcccaccatacttgcagtggatatcatattacagaccattttttccgccgtaccggcctttaacctggtagagccggtcaatatttccggaccaaccaccagttcaacggcgacctccgcttcttttgccagtatggaaccggtgttgcatacaatggcagccgtcctgcatccggtttttcccgcataccgcagcccgcctaatacataaggcgttctgccgcttgcggcaatgccgaccaccacgtcatctgctgtaaggtgaatgtttcttaaatcttcctctccaagggcttcactgtcttccgcgccttccactgcctttataaatgcaccctctccgccggcaatcagcccgatcacttttcccggttccactccaaatgtgggaggacattccgccgcatctaaaagtcccagccttccgcttgtgcctgctcccatatagatcagccggccgtttcctccaagactttccgtgcaccattccactatccgggcgattttctccatctgggtttttactgcttcaatcaccttttcatcttcttcattcataatacggatcaaatccagaggaagcatttcatccagattcatggttttaggatttctggtttccgtgaccatattagacagatcaatcatccgtatcctccttcctaagatatacctctgttttttcaggtatgtcttatttattttttccaggttttcatcaaaatgcagggaagaaccgattccttttcatatccccctcaaacgtcttccccctgctcctgagttgttttcattatacatttgtgcacttttttgtcaacgaatcttcaatattacgaaatcttatttcataccttgaaacaaattatcaaatatcgctatgatttttaacattttttatgcatttttttcattttatactttacttgtaaactattattattgcaatctgttgagaatcccttttccgcttcctgccgatttgttttatccggattttgattcatcatgagcctcccaacgcctttggtctgatgctttaaagtataaaaaaacaggccagaaagtctgcaaaaataagacatttctggcctgctgaaacagcaagtcacggggcaattgcagccccactgctccgttcgcctccgccggtattggcctgacaaagaccatggaatcaaccccgttaagctttgtattacttaatttgcactactccatccacgatccactctccatttgcgttgacagcgtaaccgtctggggtgatggtactcttaagcatagcgccatatttgtactgcgctgcctggatatccggattcaagtagtaacattttccgttaatccatctccagcccataaccatggccccgtatgtaccatcatgattttcgctcatgtagtaccagctgccatcctcgtctaaataccagcctgaaatcatgtaaccatctgcatcaaaacggtaccacgacacctgaccatgataggaacactgataccattcatttttcgcataggttccatctttcttaacagcctgccagcctctggcattctgtttccattctacactggaattggataaatgggactttgtatccgtgccggaatcttcctctctgtctgagctgctggggcggtccgggttttccggaatatccggtttttcaggaatttctggtttttcaggaatttccggcttctcaggaatttccggcttctcgggaatctctggttcttctgcaagcttcacatcgtctctgtcacgaattcgtatacgagccacagaatcctcagagtcacctataacagtcctggatgaaagacctgctgccgacatatatgcgccggtttccagcccctttatcaccttatccttagtgatatatccgtcgataaatattcttgcgggtttcccggactgatcctgcagcataatcgtttctaccagattattcggcgcatcaatggaaataaccctgccgcttaccgtgaccagactgcccaggtttttgccctcatatgcttctttcgtagtttcttttacaggctctgggagttcctttatatccgtatcaattaccataagcttctccactgccagctgtctctctccctgataagaagaagtttttccaaataccctgatggtctggcctgctcttatatctcctgatacaggaaaaagattaattccgccagtctcatcctgcacatagatactgtcaaagaaagcagtatctttatcataaccggaagcattggatgtagctatgccttcgataacaaaccgctcgccctcaccggctgcctgcacttcctcaataggcgtaatctgcaattgattcgtcttatccaacaaattcgccataatctgatagttgctgtaatcattggtggccgcactgtcaaatgtcagctggaaatcactcatagtcgaacagcctgataaatagagggtagacgatacgccgtcgctgaaatagagttcctgagtagctgccaatacaaaactcccatctaattttgtcaatgcatctccggataatcctacgccgtctttatccaggcttttcgtatctgccggtgcgtataccagagctgcagctcctgtcggaagcatggcgctgtcactgaccggatttccgccttcatctactgcataaatatccgcatttccataggtgttgaatttaagcccagcatccactccggccatatatgggttcagctgattataatccttgcccaggatcccgatcactctgccgtcattgctggaagtgcactgtaactcatcatctgcaaaacggaatgcacttccaagagcttccagaatcttgttctgctgggcagacatatgatcctctgccttggatttgtcacctatgaaaccatcatatgcctcataggtatcactccaggcacagaccataatcgtcttgtcacccttttgggcaaaggtcctgacagcttcaagctcttcctctgtatagttcttataatcctcccgcagctttgtaccatcgcgtctggaaggcgcatttaacaatagtccgacatatttgtcatcctttaaagcagccatcagttccccgcttgtattaagcgtgaccatcctgatattgtaatcccccgctaaggcggtaaaattccccatgctgtccttatagtttccattcacatactcattataatgactggcatctattccaaaatatttcatcttagaactgtcacgtacttcgatttccagagtaaagctgaatgtctttttgtcaccttccagttccatttgggcagtgacttcgatttcatttgctcctaccttatcaagtataaactccttgtttaccgtatgcgtcccaaatgacttcaaattcacgtttaaatcttcgcttgcaagcaccttatcaccggttttaaatgtcagcccggtaagtacggcatctgattcttcattattaaaagcagtgactgtaaacttcaccggctcacctgtcaccggcacctctgtatcacaagtgaaggaagatatgcctgcctttgcagcggaaccataccacacaggagccgttactgcgatatttttatccgcctgagtaacacgtatgtaataatatcctttcttcgcaggaagctcaaatgtgaactctccgctatttccggtgccttctttttttcctgctattgcgccgccatttgtcactacttctacacttttgatgacatcggaaggatccggatcatctacgcttacagaaatattcagcgttttcacatcatcagacacatccaggatacttcccataagctgatcgttcaaagtatacatgatattcatgtttttatcttctgtcgcgtatacatgcatgtctttcagcgcatttaaaatccctgtctctgacaaatcatctgtgagtatgactgtcctggccgtattcgcattgccccagcgccctttatggttatcctgattattggcgggcgctaaatgccagcccttatccaatgctttcgtatattcattgtaacttgggaagtatccgcctgaaccgatagagccttcgccgttgcctacttctactaagaccattttagcgtctcttgccggtgtatagtatgcaaaatctgaaaatgtaccaaaggtcttgcccggatggttaaactgtgaaagatttgccaacggatccggatcagcggttaaaatgtcatagtacgccttcatgcctgcatcatttttcttgtcatttagcgtggtattgttacggctgaccagtcctgatgaaccaaatgtattgatgtggccgggaccgccggaccatgtcatctcgaaaccggaaagcgcctttctggaactggtttcgttaaataatctcgtctgctccctgtattcctcccatatggccctgctctcaggtgtcataagagacgagtcattaagcgcctctttgggattgggtgcatcctttgtatcaaaatagttggaatggtctgtaaaggatacaaattgtacattgtcctcttccggtatactggcaagataattaagaccatctttaacagacccggaaccatccgaatagttggtgtgtccatgaagctgtccgaaatacgcggtaaaagcagactcgccgatggtaaatttccaattctcggtataagacaccttatcttcccgaataacagtcacctgtgcgttgtaattgccgtcttccagtaccttggacgagaaagcatatgtcgcactgtcagcggctgtctctttgagattcataatctggtctgtataaatggcagtgccgtctgccttattgagagtgagacttaccgatgggttatttccgatattagtcagtttgacggatatctcaggcgctttcacatttcctgtcgctttatttctttcaggagtgaccgccagtacctggggcttgtcattgataaggatggttacaatcccactctctgctttgagaccggttttatctgttgctttgaattttatgtataaagcctgctgacccttagcaaaattttctgccggaataacagcctcataattgttggtatcctgattaaatgccatggacagtgacttgcccagcgcatcctctgagagcccgaaaaggacttccacactggacacgcccacattatcccttacctggacggatatggggtattcctggtccagcctggcatcaatataggtacctaaggtaatgaccgggggtttggtgtcatttttcacataatagacaggaaagccatttttctcttcagtgccggtgtatagctgaatcgtctgattatatctgccaaccatggcagttaaatccactgtctctccttcttcaacgccttccggatatggagctgcctgataaatattaatcgtgccggttgcatcagttacaggcgtactgcctgatgtattaagcttaccaagtttgacatcctctatgagaacaactctgttaatcagtccgcttttctccaaatcagcggtatctgccatggcttttatctgactgatggtatacgccgcaggcggtatggatgcttcatcctgcttagcagcaatttttgctttatcttttgtggatgttatctgaggcataccatagcggatctggaaatcccccgtgatttccagtatatcacctatcctggcgtcatccggtgccgctccataaatatagatgctgtactggctgccatctatcacggactggagcaccggatttccatatgtggtggccagatatgacaattcccctgtaacggtcacatcctttgtgctctggcccagggcaagcacatctttaatcgtcatcacttcgccggcttcacggattgtataggaaaactcagctatttcactgtcctccaggccttccttaactgcacgaacataatatgtaaccggttcatcaatgatcagtccgtcatcctttgaatatgtgatccattttccggcagattcagactctgtattatacacgatctcagcatctgatgttgccgtagaaaatgtgagcggcgtaccttttagtaccgctccggacgccggtgatgcagcaggcgtgctgcatttcgtttcttccggcaaggtcccgccgccttcctcataggagctgttgcggggctcaggcttaccaatcttaaaatcagctctgttgtcgtcggtatccactgccgggtccttgcggatggcggctgtagaatttgacattggggtggttgcttgggtctcatactcctttgcttcgccaattcctactaaatctacgagattctcatcgtttttatctgttaatttcacggtgtctttggacaatgccgctgccccatcggttgcagacattgcaatagcacctatagcgtcaggttccggaagttccggcgcatctttattcgttccatctgcttcctttatcaggtagtagccaccggcttcgatggtccctgaaagttttgtcagctggccgccgcctacaggattataggcgctgaacgtgcttttccccagccactgtattgaccacccatccaggctcacatcttcatctgtaggattgtacagttcaataaaatcacttttccatatacaattattattgcctcctccgccatatatctgactgatcactacgtggtctgccaggccgatgtccgcaagtgtggacttatcttctacagtttccatagcactggcttcctcttttacagcgtccgtatctcctttatcctccgtatttcccttatcgcctatatctcccttgccgcctgtatcttcttccatcttttcaggaatgtccccatcaatgtccttgtctgcctcactggggctggctttcttatctcccccgccggaatgttcctcctcatacccgtttgtcaggttcgaatctgtcttcatcgcaaagccaggtacaactaacaaattcatacacatggcgactgacagaaacaaacttaacagcttccttaagttcataacttttcttccccttccatttttattggtatcatctaattaaaccttattatgatgaattataaaaaattaccaattttatacatgtttttaatacaaaatatgtgaattacgctgcctgtttttctaccttttattctttttgttaaccgtcatgaccggcctgtccgctgcatttttcctgctgcacataaacgcgctcaggaatgctactaacggcacagtcattacaatacctatcgtccctgagataccctgtataatctccaatgccatcatatcactgttaaaaatctgcaaatatggatagtcaaagattctgaacagtattaacatattcagtgccgaaccggcaaacgccaatatcagcgtgttagccatagtccccatggcatccctgcctatattaatgcccgactgaatcagcttttgtctgtttatttccggattcagctgatgcagctcaaatactgcagatgtaatcgtcatagccacatccataacagcaccaagtgctgctatgagtatggcactgataagcaatccgctgatattcagacttgtcccacctgtgcggagaattaattcttccgcctccggcatattaaaaccgtttatcggcgtagccgctgccgtgagagctgcggcggctcctgcaatcgctacaccgcccacgcacccaatagtcgcacagaaggttttcatggaaaaaccatttagcagtaccagggaaacggctgtggtaacagctgctatgacaatggatgacaatatgggattgatgccatgccttatcattggtataagcaaaaaccagatatccacgatagcaaatgcaagccccagtatagcggctatcccttttttcccccgaatgcagctaaaaacagcacgaagatcaccgtcagaccaagcaatgccggccccctgttgtaattgggtatggatgcgatataagaccgtccattggcatctatatccatccggacgattacttttgtacctgtttttaagtccacattgttgtatacactcatgtaattgactgccggcaatatcttacctctgccctcaccgctgtcgatctgcatatagacttcctgcactcctatacgcagcccttctgtccagtcttctgctttcgcctcgtcactgatgacttcagtcacatgtgccctggcaaattttatctggcttgccgccgttggcacatcccccggaagcggctgattgatccatatgataattgctataaataccacgcagaaaaggaatgagactattagttttatgcagaatgttttctgatttttcatttacggtacgcctttctgggaaaggcacaaaatggttataaacctgcgcccttcgtcctgttaattttgtattactcttaagctgcaatgccgacacatggccgagcctgtaaaagcgataacatgtacataatttttctccaatactgctttggaagcacaaatcatgttaagctccgtgaaatttaacgttcagtatcattctattccggcttcagccacttaagtactccttaaaaataaaaatgaccggcataaattcaaaggattttcatacaaaaaaaagcaggtcagaatgtctgtaaatataagacatttctgacctgcaaaggcagcagattctgaggctgttacagccgtatattaaaggacaatacaccacaggggaatggtcaccagagataacagggtggttaccaccacacattttgtggcaaaaatataatccccgtcatattttgcagctaatatggcggtagtgcttcctgcgggcattccggtcaaaagtacggatactccggacaaaaggggtgttacatggaagacccggcagcttaagtaaaccagaagcggaagcaagaacaggcggatgagggcatactttacaattccccggtccaatatgcttcccggctccacctccgccagtatggcgccgattaagaccatggatatggtggtggtgcagcctcctatgctcctgatggtgttttgaaggaatacaggcaggggcagccgggtgatcataaggatcagtccgatatagaccgcaatgatacagggatgggtcagaacctttttcacaacggttttcctgtccgggctttctgtaaaataagataccccggcagaccacatgacaatcctttgggggatcaggaatatggacgcatacataagcccttccgccccatatacaccttctgcaatgggatttcccataaacccagcgttggaacagaccgtgccatactgaagcacctttttacggccttccggctccctgttatagagaacttttgcaagtatgagacagcccacctggatcagggaggcaatggtaaggatgatggcaaatccctttaaaatatcaaagttaaattctataaaaaatgaattgatgatgttgcaggggagaattaaatagatcaccagatccgtaagaatattctttgccccttccggcaggatgcccatttttctaaggacaacgcctgctgccaccaggagaaaaagcattccctggagatttaaaagttgttgataatccatgtttagctctcttcttttgttttcatatattcatccatggccatggccactatttttgagtaagcaactgcttccaccacggttctggccccaagaaccacatctccggaagcaaagattccgggaatagtagtctggcctttttcatcggtcatcaaaagcccgttctggctggccaataatccctttgtggtgttcaccagcttgcttttcgggccctggctgatggaaatgatggtggaatccgcaataacctgttctctttcttcatcaatgccggtcaggtttccgtcctgatcataatggatgttttcaaacacaggcccttcatccgtgatctccacgatctgctttccaaactggaaatccgccccgtcaagccttgcataagctgtttcatgatcgctggcattgctggataagcctcttgcataaagggtcacctttctggcaccatggcggatcacggtccttgccacatccatggcagaattgcccataccgatgatggcaaccgtctctcccagatcataggcatcgggattggccagatagtcaatggcatagtggacatttcccagggattcccccttcacgccaagggttttcggcctccagacacctgtcccgatgaaaatgctctgatagccgtcacggatcagatccttgatttccagggccgttccaatggcggtgtttggccggatcttcaccccgatttccagaagcttctttttgtagcgctccaatatggtttttggaaggcggaattccggtattccgtattggagaacgccgcccaccttatccttggcatcgaaaatcgtcacgctgtagccttcctttgtcagaagaatggcaatggtgatcccggcaggaccagctccgatcaccgccacctttttcccgtttttgggcttgcattccaccttcagctgattgaaaatggtatcagaaatataattttctatgctgctgatatgcaccggctgtccctttttccccagaatgcagtggccttcgcactgcttctcatgattgcaaacaagggaacagactaaagacatgggattgttttcaaataacatctctcctgccttgtttaagcttccttctttaaatgccgcgatcatctggggtatggggggggggcagccctgacggcataagggctttttacagtttaagcatctgtttgcttcatcaataacatgaacagccatgattcattttcctctctttttctgttgcctgtggattttatctttgaatggttctttcgttgcatattgtatacagttttatttttcacatcatatcacactcaaaataacaaaatcaataggcatcaattatgtacagaaaaaaataaattatgacaaaaatatatcgaattcacagggcagaattcctttttgaatcaaaaaggaatccggcagttaaaggcggaagaaagtgttcagacgccgatattgcggattccctctactaatagttattttccctcataagtgatcatggcttccacatcatatcctgcaagcttttccctgccgtttaatcctgcaagctccatgataaagcagattttcaccacttcgccgccaagctcctggatcagctttatgatggcttcaatggtgccgcctgtggcgattaagtcgtcgatgatgaccaccttttgccccggcttaatggaatccttgtggatttcaatggttgccgtaccgtattccagctcataatcagcagacagaacttctcttggaagctttcccttctttctcaccggaataaaacccttatgctctgcataagccaccggaacgccgaagatgaaacctcttgattccggtcccaccactgcatcgtactccactccttttaacatctcccgtatgccatccactgccagggaaagtccgtccgcatcctccagaatggtagtcacatcccggaaaataattccttcctcagggaagtccggaatgcttgtgacataatcttctaatctcttcattgtcatacctcatattgtcataatttgtataccagggagcctctatcctcttggatgggcgcccgtataggaacggcgcaggtcttctccccgggtatagttcatatacatctgggtggtagccatatcggaatggcccagcatggcttgtaccgcgtggatgtccgccccattgcggagcaaatgcgccgcaaaagaatggcgcagagtgtggggcgtaatatccgccttgatccccgccttatccccgtagaactttatgattttccaaaatccctggcggctcatggattttccgttgcagttggtaaacagccactcggattcctgattccgcagcaaatattcccggccacgttcgatataagcggaaagggccagcttggccacctttccaaaaggaaccatccgttccttgtgttcatcccggcaggtgatatatccgatggccagattcacgtccgtcttttttaaatggatgagctccgacacacggatgccggttgcataaagcagttccagcatggcccggtcccgcagctccttgggagtttccccgtccggctgacttaagaggctgttcacctcatccacggtcaatatagtaggcgccttcttttccaccttaggcgcctttatcagctctgccgggtccttctggattttcccttccctgcattcgtaatggaaaaatgccttcatggaggccaggcagcgtgaaatggttgtggtagccttcccttgcttttcgagatgtaagatataggaattaagactggtctttgtcaccttgtccacctcccggatcccctgctgttctaaaaaggaagccagctgcatcaaatctctctgataagatacctctgtgttttttgatgttttttttctcccttaaataaatgataaaataattaatctctgctaccatctccatatcccctgacctttcggcttcaaaaatgccctaaaataaggcttcttcctaccattatatagactattttcgataaaatcaaacacatttttcccactattaatacattttgggattactttacataatatgtacaagatattggtaatgcatgactttttttcgcaagatatggggaaatggaccgatttatttttttttaatatttctgtgttaaaggaccattttcaggaaaaatgggttaatccaggcttcacaggcgcttcctagggccgccaaaaacaaaagcagcaaaaaagccgtgacccgaaaacgcctctccttttgcattccccacaaaagaaggatgctccaaaggggaaggtagcacagcccctggggcatgactgtcatgaggaacacgggaagtcccataagccccttttggaccgttataacggaaaggacaaaccccatggaaaaaccgattcctgccgtcagcaggcaaaacagaggcgctgcataagcggtcaggccgatgagccatgcaacccccacctctatccctctctgtctgaaaacctgataaaaaagctgaacccgctgccctttgtccaggttcatatttctgtccaaaagtcccagataatatccggcttcctccataaatgacggataccagaaatttgccatcaccgttccggcaataagccctgcaaaaaagcaaatgaggcaacggtcctctgcccccaagttccgctccagggacgcatacatggcacctggacccggtcttcttctcaaacggaatctaagggtgcgaaacaaactggccataaaaaaatccccctacaggtcttgtcataagacgtctttctttcaaccttatgcctgtaaagggacatttattcttgtaagggcaacaagccggggcaaggaaactcaccccggctgaaactgctgttttacaggcgttttactattttacgccgtattttcttgcataagccagaatggccgcaatggtcttaccgtcagtgatctctccccggtaaatcttctgctctaagtcacttacctcccactcctctacctcgatgtattcatcttcatccaggttctgtctggaaggctccaattctcttgcaacaaagatatcaatggcttcatcacagaaggcaaccgttgtgttgacgctgattaaatattccatcttttccttatccgtcttatatccggtctcctcctccagctccctgtgggcgcagtcaagctttggctcttttgcgctgtcaagagcaccggccggaacctccagggtataacggtccaaggcattgcggtactggcgcaccatgagaatcttcccggttttggtcacaggaaccactgcagctgctcccttgtggtgaatgaaatcccagtgggccagatggccgttcgcatccaccgtgtcctcaaatatttctataatatttcctttgtactttaattccctgttaaggcgttttacaggtttttgttccatgatcttacctccgcactcatcctttatagtttctcgcacttcttaaagcaggcatccgctgcctttatgaccgcactgcggaatcctgattcctccagggccgataccccctcaatggtggtccctcccggcgagcacaccttatcctttaatactcccggatgctcccctgtttccaggaccatcctggcgcttccaaggactgtctgggccgccatctcataggcagcatccctgggaagtccatacttcaccgccccatccgccagagcctcgataaacatgtaaacataagcaggggagcttccgcttgcgcagaccacggcattcataagacgctcttccacgatccgcatccttccaagagatcggaaaatggcctcaatggtctccttctcttcctgggaaaatgccttctcatcatagcaaaccccggtcattccctccccaaggagggcaggagtgttgggcatggcccggaccacccgcgccttttctcccagcttttcctttagccaagccgtagtgatccccggcgcaatggaaatgatcacatggttttccgtcacctcattgcggatatcagacagcacgggttcaaagtactgaggctttacggccagcacaacgtactttgaccgtcccgcacaaccggcgttgctttccccgtgggccactcccagctcctctgtgatctgggcgcaccggtccctgtttacatcggtaaaagtcatatcttccttaccccatgtctttaacagtcctttcaatattgcaaaacccatatttccaattccaatgattcctatcttcgccataatccttcctcctgcttctgtatgaaaatctgcagccaataaacatcattctagcaccatcttttcaactatgtcaatcattggaatcctcctgattgacagaaatgatccgcaccccctgctttcgaagggcagccttttcctgttctttaaattcatgatccgttataatccctgtataatctgccagacggttgatccggttcatcccctggcggttgaattttgaatcatccacagccaggaaagactgctggcactgctttacaagctggcgctttaaaaatgccttgtcagtggtcggcgtcagcacatggaattccccgcttatggctgcagccccgaaaaatccggtatcaaaccggaaatcctctatcatctgggtggtgtaatagcctaaggtgcttcccgtggacttctggacgtaaccgccgcacaggatcagctctgccttgctgtttttcatcaaaagggcgatctccaagtcattggtgatgactgtcatgttttccatctccatgatccgctttgcgatctcgtaggtggtggttcctgcatctaagtatacggtagtcccttccctgatgaattccacgcatttttctgcgatcagctccttttgtccatgatttttcacgcttttatccgcatatgccacctcagtcttgctcaccgcacctccgtggcagcgttcgatcagcccctccttctgaagcttttccaaatccctgcgaatggtcataggactgacatcaagctcctttgccagctcctctacctggacgcttccatcttcctgtatcatgttcagaatcttaatctgcctctccgccatcatcatgagcccttcctcctgtcatgaagcctatacctgttttattacaaaaatccctgccgccggaaactccggcggcagggcatctgcttactgcacaatatcccatgtgtatatcataaatgattacaggaaaatactcaatattaaaacttcaacaaatccaacggcccatgctatggtggaagtgatggaataagtggcgatctgatcctttacttctcccactcccagggtccggttaaccacccagaaatagctgtcattaaagtagctgaagaacagggagcctacgcagcatgccaaagctccaagtatggggttcacgccagcagccagaatgatgggagcagatatgctggcagccgttgtcatggcaaccgtgccggatccctggataaaacgcatggctgtggaaatgaggaacggaaggatgacgatgggaaccgccgtacctgcaagagcttccgccatataggttccaaggccgctgtccttgatgatctgacccagggcaccgcctcctccggtcaccagcatgatgattcctgcggatgccatgcctctttccatttccttgatcgcctcttctctggttaaattccttcccagggtgaagatggccagcacaagtccgatgcctaccgctacgatggggcttcccaggaactggaatacctgcataaagccggaggtctttcccaaagcgctggaaaccgtactgatcaggataaggatgatgggaagaaacagaggagcaaaggattccagtgtggaaggcaggttttcaaacccaacggaaaaatcctgggagtaatccggctcctgataggggaggcgcacaaagccttccttgtcgtcagggatctgataaagccttttcccgatccatcttgcataaaacgtacaggccactgtcatgggaatggccacaacaagaccataaagaatgaattttcctacgtcaactccaaagattccgcatacacccaaaggcccgggagtaggcggcacaagggtgtgggtgatcacaagccctgctgccagtgctgcgcccagggaaatcactgattttttggtcacccttgaaatggcctttgcaataggggcgagaattacaaatccggagtcgcagaaaatggggatggaaaccagaaatcccgtaagtgccagagcttcctcctccctctttttcccaaagagctttaaaaacgtctgggccatccgcttggcagccccggtcctctcaaatatctgtcccatcattaccccaaaaccaatgatgattcctatacttccaagcgtgcccccgaatccggttgttatggaattaacaataccaaaggtcttgccgttttccagggtgatgttcactagaggcataccccctaccacgccgatgatgaccgatgccatgatcagggccaaaaatgcgtggatctttgttttcagtaccaagaatatgagaatcacgatgccgattccaagggcaatcatcattctttcgccgctaagtcctcctaccataaagaaaccctcctcttaatttttcactgccccttttacgcctttttaaagcgaggggaatactttgctgcaagtaaaacagcctccaccatgctgacagcgcttgccttgccggttccggcgatgtcaaaggccgtgccatggtccacggaagtgcgcagaatgggcatcccgttggtgacggcaatggtgcggtcaaaatccagggtctttgttgcaatatgaccctggtcatgatacagggaaagcacgctgttaaaccgcccctgagccgcctgatggaatacggaatccgccccgatagggcctgttaccggatatccctcttcctgtaattccagtacggcaggaatgatctcattcacctcttcatcaccaaataggccgtgttccccgcagtgaggattaagcccggctactgccatggttccctcctcaacccccagccgtttaagtgcttcaaggcagcgctttacataatccttgatccgctcctttgtcaccatatccagcatctttcttaaggaaacatgcctggtgaggaaaaagaccctcagcccattggtctcaaacatggtgagcggatcctcagtttccgtcagggcgctgaatatctccgtatggccgatgaagtgaatgtctcctgcctttaatgcctccttgttgatgggagtggtagccaccgcatccgccctgccctcgtttgccagcctgacgctttcctcaatgtattcataggcagccctgccgcacatgccgcttacctctccaaaggcaaaccggtccatgtccacgttatccagatcaatgaggtttaatatcccttcctcaaattccccttcctccggctcctttaccgtcttaatccttaagtcagtcccagtgatcctgatggcctgctccatgatttttctgtctcctactgcaatgcatctggcagcctcaaagactccccgctctgccagcgcctttgccacgatctccgggccaatgcccgccggatctcctattggtattacgattaatggtttgctcatgtttatttcctccatttctcagtttctataaatttacataaataatttctctttcagataagtgatgcaccggttggcagcatccggctctcccaccataccgccttttgttatgatggacacgccttcgaaatctccctttaaaaacgtcccgtaggctgcaaggggaaggacctcatcaaggaggcataagcctgcggtatggaaacttctgcagatggctaccgtaatatcccctccgctgctgtagattccctgaaagctgctgttgcttgtaaatatcctgcgggtgatctccgcgaaggaatcgcagatcagtccggtcatctcatctaccccgcctggaaaaccggattcatactttttaaaatcgatcctgttttccggatagatcccatctcccgtgacggtcaggatatcaaaggacttactggcttccagtacctcattgactgcccggttgatttccccttccctgctttcatcactttccaggaattttgcagcggaaacaaaaatattgtgggcggtgcgctgggtcagccacagctcttccatctgttttcttgtcacaggatttacacttcccaccacagccagtatcttgtttttcctctccctgtccggcggaacgatcagctttcttgcaacggtggaagtaaacactcccggatccaccgcggcaaatttgattttgcttgtaatggccgcatctgcgatcagatccaaatcctcctgggtcacacagtccatgatgatgatcctgcacccgtcctctgcaagggctttgatcctgtctgccagaacgtgctttccttccatcatgccgttcatctgaatgctgcccaccttatacttgctctgagcttcaaatattttcttcacatctgatgtggacacaggtgtcttgggatccagggcagcttctgtcttgtggaggggaagcccctttaccatcatgtatcctccgatcacgacccttccggaagctgggaaacagggtgcgcagatggctgtataatcctggcccaaagcatccaggagagcatctgtctcacttcccacattgccccttagggtgctgtcaatgcgttttgcatataccttgacctcatcattttttaaaaggtttgtcacgttaaatacccggttgtaagcagtttccctgcttgctcccctgctgtctgtgggatatatgatgcagtcgcactggtcaaacagcgacaagttcagccgttcggaattcattacggtataggtccggtaattcattttcttaagcaggaccccggtggcatttgccccggttaaatcgtctgctaccacaatgcattgaggcatatttcctctcccttctatccattggctccggagtggaaacacgtttcttccggaattttccaatgtttgtttatgttcgatatttatgttcatttatgttctaaatcttacattgtttgttcgtttttgtcaatatattttttatattcttttaattttttattagttttgttaagtatgtttttatttgtttattttctcaacaaagagtacaagtattcgtttcatgaaagagtattttttttccgccaccccggatcctcaacggagcggtaaaaacatggtgccacataaaagccggcaaggaaaaaaggcggcaggattctcatccaaccgcctttcatatctccgctgtaaatattgttgcaccggaccctattcttttggaagcccttccaccaggctgtctttgatccacccttccctgccgtcttccaaacggacatatacccaatggttctcctgattcagataaagcaggcttgcatcaccggacacggtccggataatactgctttttgccgatgcctctgccctgatattagaaccgccccttccttcttttgaaagggataacatgacctgctcatcattctcatcgggcaggtcctcgctttcattctcagcttccgcctttctttccttttgcttaaacaatggcggataagcttccgccttttttaaaaccccctgctccaggctgcggtacccgctgtttataacagagaaagcaggcaggtagttttcatttacaatgctgcgcagcatttccggaagagcgatggcaactgtcagtaccagatatatcccaaagaacatgccaaaggaaatcctttttttctttgccacttttttcgagaaaccgcacattccgctgctgactgcttcagcaattcctgatatcctgttcagtattgatgaccgttccgtctggctttttcctgataataaaacttcggcaagagatatgatcccccaataaactcctttgatgaccaaatctgccagccggatgaatacaaaaatcaatttcatcaaaagcggcattaagaaaataaagaccaccgtaaaagtgataccaatcaccagagccgccctcactgcaacaggccagtcccgcatctgggcccaaaatccataatgcaattctaatagcttcattggtatttattcctcatcctcttcaaattcccggtaaatattgacggcttcctcattggcatgatcttccagtgttcctgccacttctttttccgctgcgtaagataagtccgatatggaagaaattattccgtttaataagacctgcacatttttaagcgtgtctccttcccggatcatctcgtctttttccaggctcctgatgtagtccgtggcttccttaatctgcctcattctctcatcaaaatcctgggataatcccttcttggaccgctggatcgcctcttccaccccaatcgttccggcagcgaactcggaaaatattgccgtaacctggtcagaataaatgcttttcatttcctgggcagcaaccgccttgctcttttcaaattccgtatgatatcccagatccagctgcttttcaagaaagctttcgtacttcttgtccacctggacaatcacgttgcaattgctcagactgattccgttttctaagtaactaataccagacaaagcctccttgatctcatcctttagtccggcattctccctgatggaatactttgccgccttttcctgaatctgtgccagagtgtgatcctgtacgcactgggtcacatcatgtacctgctcctgatatacgatatccggttcctttacattggccgttgcagtaaccgtgactgtaaatttcgagatattgtctttgctgtatacctcttccttaaagctgatattatagggatgaagatcaatttccaccagctgatcatattttccccttctgatatccgctaaccgaacctgggttccattttcaatgagaagcggctctgctcctcctgctcctgacaacaataaaacagccttctttggtcccggaatcgggattttagaaaaaaaagaccttttaaaagcttcttctttcaaaattggattaaatgttctttcaatcatcgtttttatcccccgtattttatcttctgctgctcagcagtcccaccagatactctttcatctggtctgcaattgcttttccttcctgttctgtttttatccttccaagggttcttaaagtatgctcaaaatccgtttcttcaccggtaaaagcgatcacctttaagaaattcttcatataatcccagggcctgttcaagtcccttaactccttaatatacaggaggaggatcttctctaaaaacaactggcgtaatatctgcttctgccagacatagcgcatgagaggccccagcctttttcttgattccctgctgttaaaactgtttaagaaaagggatctgtacaacgggtatccttcttctatgtaatcctgccacatgagggtcataaaatagtatccgaaccggagtctgtctctcttcttttcgcacagttcaaactgcccggacagaacctctatatacaactgcgccatatcttccttttcctgaagcagatcaaagggcagttcactgtcatccttaaaaaagtaaaccacctgttctaactccacttccagtccggaagccagctcagctcttataatggtctgcaggcggctgcgcacctgggaatgaaagccgtaatttttatcactgtcatacagacaaaaagcaatctgccataaaacctgattgttatccagttcagcccagtgacacagcaatttctctgcattctcccggtatgcttcctcttccaggcaccgttccataattttcagcagaaaataaaaattatccctgttatggctttttacaaaccgcggaatgatattgttctgcgcataggcaaaatccatggaagcaaactcagctatggcttccccgatctggcataatattaatttccgtacaggccgtaaacggcttatgtccagcagccagtcaatcagccctttcctcatacctggataaccagtccacaattctttgttcagctccggaataatggaaggatttttaaagatcacgctctggaactccagccttccggcttcgctttccatagttgccaaaacgatttccgcgtttaaaaactctaatagttcttccatggattgaagtgcgtttccctttacctcaggctgctccccggcctctttttttgtatatagatgcgttttcagcacctgggatacatcaaccagatgggataccgggaccatctttaacacggtgatggtgagaaaaatcggcacatagtccgtcagcacataccgtttaatcagctccttcatatccttctgatccctgaattgaaagggtgcttccccctcctccacagtctgaccgcttccctgattgatgctgccgttaatttcaccggaattgaaaatgaaatgattcaattcctttccgtcaataaaaaagcagttatgatactctccatcccctctttcccgtctgttctgctccttttttctctgatactgctccggattatattgatctaaaatacttccctgttcctctttttcaggctgtattttttccttatcaggctcttggagccgctcctcttccttacagtcttttgcaccatcttccggcgggctggtgttttggtctttttcttcttccgtttccatgtctttccccccatgaaatcaaaggtatcatcggttccttttctcaaaggaatgaatgatgatctttattttttcagcaacctctacttctcttaaccggtcagcatccaggaagtgaatgtccggatccagctcctttaaacgggatccgccgaaatataccgggatcaggcaatttctcttttcctctttttccctcagcatggctgttttcgcctcatgcatggtaatatccttgtccaaatagtccctggaaacaaagcatgccacaaacatgctttcatagcggtaaatatcataaaactccgtgatcatatcccgtcccaaaaactcctcttccctgttaggagcaaaaaacacccttaagttttctttttccagaattttggcaacccttgtcacataccgttcctgttcactggcataggaaatgccaacgtcatatttgtatttactggaaatgcctcctccggtcttctgactctctttctcagccgttaatggggtcccggctgcagatttctgtattacatttccgttaatcactccgctgtttatgatcatattatttgccatcatacttcccccgttttcacgtttatttgttttatcaagatcattttaccaaatttttctaaattctgcaaataatccattcaaaaaatcaatatacaaaatcgtcttcccagaattaactcatttcatgtcgtttttttatcatttcacttttaactcccttcccttgtccctaacaaaaaataaatttcactattgacattttaatttttatcccatatactgtagcaaaacaaagcgataaactgttgagcaggagtaagtaagatcttttcatcatgcacagagagcttccggtcggtgagaggaagcgttggtgtctggtctgaatggacctgcgagggcggcttgaaaccggattcatttccgggagtaggtgtcgacgggtttcctatccgttatcaaggggaggcacatgttggtgtgctgtaaagtgggagaagtctatcttctccaatcagggtggtaccacggaaccgtattttcaggctttcgtccctcttatccatagcaatatggaggagggacggaggccttttttatcgtataggaaaattcgtcctatacgataaaaaacctccgggaggatcgcactgcggcggtagggttggatgtcgccgaggcgacccgccgcaagcgggattctttcttgcttgaccggccgtcaggcctaaaaacatacgcaatcaactgagaaaggagcgtaataaccatgaacatcacgccggactgtaaggaaatcgaagcacttgctgcttcctatcctgtcatcccggtctgcagggaaatctttgcagacattgtaacacccatcaccctgctgcgaaagatcgcagccaaaagcagccggtattatctgcttgaaagcattgagggaggcgagaaatggggacgttactcctttcttggctatgatccggtccttaaggtcaccttaaaggatcaggtaataagagtccatcattatggacagccggaagcggataaagtgatccggaccgagaagccctacgatgtgctgagggatatcttaaaagattaccgctccccaaggcttccagggcttccgccctttaccggaggatttgtagggtattttgcatacagcatgatcggttatgcggagcctgtcctgtccatcaaaaaaggggcctgcaatgattttgacttaatgctttttgatacggtcatcgcttatgatcatttgaagcagaaaatcagccttgtggtcaatatgaaaaccgaccgggtcatggaaaactacgggaaagcctgtgcaaggctggaaagcattgcggccatgatcggagaaaatacccccttaaaaaagtctgcagtcaccggccggccaaacttccgctgcaatgtgacgaaggaggagttctgctccatggtggagcgggcaaaggagtatattgtggacggggacattttccaggcagtgctttccagacagtttacaagcgattaccaggacagtctcttaaatgcctaccggcttttaaggaccaccaatccatctccctacatggtatatctccacatggatgatacggaaatcataagcacctctccggaaaccctggtccgtttaaagaacgggcggctcaccacctttccggtggcaggctccaggcccaggggaagggacgaggaagaagacagccggctttccaaagagcttttagaggacgaaaaggagctggcagagcacaacatgctggtggacttgggaagaaatgatttagggaaaatcgcagcgttttccaccgtagaggtgaccggctataaaatgatccaccgttattccaggatcatgcacatctgctcccaggtggaagcggacatcacccctgaccgggatgggtttcatgccattgaggcggtccttcctgcaggcaccctttccggggcgccgaagatccgggcctgtgagatcatagaagagctggaaacagagccaaggggcatttacggaggtgccctgggctacattgattttaccgggaacatggatacctgcattgccatacgcatggcggtaaagagtcagggaaaggtatacgttcaggcgggaggcggcattgtggccgacagcgttccggaacgggaatacgaagaatcggaaaacaaggcaaaggccgtgatccgggccattgaaacagcgggggaggtaaatgactgatgattcttttgatcgataattatgacagcttttcctacaacttagtccagatgtttggcggcttaaatcctgatatcagggtcatacgaaacgatgagatgaccgtggaagaaataagggacctctcccccagccatatcatcctctccccaggtcccggctatccaaaggacgccggcgtgtgcgaggacgtagtcagaaatctttcgggaacagtccctatccttggggtatgtctgggacaccaggggatctgcgaagtattcggcgcagagatcacacatgcaaggaagctgatgcacggaaagcagagccttctcaccattgatgtttctgatcccatctttttcgggcttccggaacagattccggcagccaggtatcactctcttatcgcagcaaaggattcccttcctgattgtctgaccgttatcgggtccgacgatatgggggaagtcatggcggtaaagcataaggagtatcccctttacggacttcagttccatccggaatcaatcctgacgccaaacgggatgaccatacttaaaaatttcttatccattcatataaaggaggcagattaaatgattcagcaggcaatccatgaagtaatcacagggcaggatttaagctttgatgctgcaaaagaggtgatgaacgagatcatgagcggggaaaccactcctgcccagatggccgcatttttaacagggcttcggatgaaaggggaaactattgacgagatcactgcctgtgccacggtcatgcgggaaaaggctttaaggctggagccggattttcctgtcattgatatcgtgggcaccggcggcgacgaagcagggacctttaacatctccaccaccaccgcatttgtggtggccgcaggggagttcctgtggcaaagcacggcaaccgcagcgtttccagcaaaagcggggctgccgatgtgctggaacaccttggggtgaatttaaacctgacggcagaacagtcgggagaaatattgaagaaaacaggcatgtgcttcctcttcgcccaggcttaccactcttccatgaaatacgcggggccggtgaggaaagagcttggagtgcggaccatctttaacatcttagggcctctctccaatcctgcaggagccacaatgcagcttctgggggtttatgacagaaagctggtggaacctcttgcacaggtattaagcaatctgggtgtcaagcggggcctggtggtatgcggagatgacggactggatgaagccactgtcacaggtcccagccacgtatgcgagatccgtttcggagaactgacgccttatgagatcacgccggaggagttttccttaaatcgctgcagccttcctgagctggtgggcggcacgcctgcccagaatgcccagatcaccagagaccttttaaacggaaaactccacgggccaaagcgggatatcatcatattaaactctgccctcagcttatacctgggaatcgatgactgcaccatttcccagtgcatagaaaaagcggctgatctcattgattcagggaaagccgccagaaagcttgaggagtttgtaaaaatgaccaatgaggtgcttttatgatacttgacgcccttgctgctgcctctaaaaaacgggcggaggcggcaaaagagaaaatcccaatgaaaaccatggaaaaactggcgtttgaatccttggaaaagacaaaggagagcaagctttcctttgagcagagcctggcctctcccggcatttcctttatctgcgaggtaaagcgggcttctccttcaaagggactcattgcccctgaatttccctatgtggagatcgcaaaggattacgaagcggcaggggctgatgccatttccgtcctcacggaaccggaatactttctgggaaacaacagctacttaacagggatcagccatgaggtagggctcccccttctcagaaaggattttacggtggatccctaccagatttacgaggcaaaggtcataggcgcttcagcggttcttctcatctgcgccctcttggatacaaaggccctggaagaaggactaaagctgtgcaaaagccttgccttaggcgcccttgtggaggcccatgatgaagaggagatccattccgcgctgaccgcaggggccaggatcattggagtgaataaccggaatttaaaaacctttgaagtggattttaacaattccctccgcttaaggagcatggtcccctctgatgcgctttttgtggcagaaagcggaattaaaacagaaacagacatccgcctcctgtcagaagccggggtcaatgccgtcctgatcggggaaagcctcatgcgttcccctgataaaaaggaaatcctggacggttttaagagggcaacacaatgaattcggaaaaaacacggatcaaactatgcgggctgaccagaagggaagatatcctggcggtaaatgcatggagacctgattacattggctttgtatttgcccccggaaaacgccgcctcacaggacgggaagcttatgagctgaaaaagctgctgctgccggaaataccggcggtaggcgttttcgtaaacagccccatggaggatattatggccctggcagagaataaaaccattgatctcatccagcttcacggggatgaggaccgggattacatccaggaattaaaaaaacgcatggctcccggcattcccatcataaaggccatacgggtccggcaggcacaggatatgaaggatgcccaggaccttcccgcagacttcctgctttttgacacttatacaaaaggtgcttacggcggcagcggaaagacctttgactggtccatgataccggacatcaaaaaaccctggttcctggccggaggcatagacgcttcaaacataaagcaggcaatgaaaactaaggccttttgcctggatttaagcagttccgtggaaacggacggcaaaaaggaccctgaaaaaataaaagatatcatacaaacagtaaggagtggaaatccatgtcaaaaggaaaatttggacagcacggcggacaatttgtccccgaaacgctgatgaacgcagtaaatgagctggaagaagcttatgaaaagtacagtcatgaccaggagtttttagcagagctttcagaccttcataaaaaatataccggaaggccttccctgctctattatgcagagcggatgactgaggacttaggcggcgcaaaaatctatttaaagcgggaggatttaaaccataccggttcccacaagatcaacaatgccctgggccaggtccttctcgctaaaaagatgggaaagaccagagtcatcgctgaaacaggagccggtcagcacggagttgctaccgctaccgctgctgctctcatgggaatggaatgcgaggttttcatgggcaaagaagatacggaccgccaggccttaaatgtgttccgcatggagcttttaggcacaaaggttcacgctgttacaagtggtacccagaccttaaaggatgcggtcaatgagaccatgagggaatggaccagccgggtagctgacacccattatgtcctgggctctgtcatgggtcctcacccctttccaaccattgtaagggatttccagagcatcatcggcaaggaggtccgcacacagttagaagaggcagaaggaaagcttcctgacgtggtgatcgcctgtgtgggcggcggaagcaatgccatgggaatcttccatgagtttgtaaacgagccttccgtaaagctcataggctgtgaggctgcgggccacggcattgaaacaggaaagcacgctgccaccatttccaccgggtctcttggaatcttccacggcatgaaatcttatttctgccaggatgaatacggacagatcgcccctgttttctccatttccgcaggacttgattatccgggcatcggaccggagcatgcggctctttatgactcgaaaagagccacttacgtcccggttacggaccaggaggcagtggaagcctttgaatacttatcccgtctggaagggatcattccggcaattgaaagcgcccatgcagtggcatacgccagaaagatcgctccttccatgggaaaggagaacatcattgtcatcaatttatccgggaggggcgacaaggatgttgccgccattgcccgctataagggggttgaaatctatgagtagagtaagggacgtattttctaagggaaaggcattcatcccgtttattacggcaggagatcctgaccttgccaccactgaagagctggttccggccatggctgaagccggagcggatttaattgagcttggaatccccttttccgacccaattgcagaagggatcgtgatccaggaagctgatatgcgggccctggcatcaggagttaccacggataagctttttgactgcgtaaaacggatacggaaaaaaaccgatgttcccctggcttttatgacttatatcaatcctgttttcgtatatggaagcgaacggtttttaaaaaatgcggcggaaagcggcattgacgccctgatcgtgccggatatgccttttgaggagagagaggaactgctgcccttctgcaggaaatacggaattgagctgatttccctcatcgcccccacttccaaggagcgcatacgggccattgcatcagaatcggaaggatttatctactgcgtttcttccatgggcgtgaccggggtgagggctgaaatcaacacaaatatcggagaaatggtttcccttgtaaaagagacaaaggaccttccctgcgccatcggctttggcatctccacgccggagcaggcaaaggaaatgagcaaaaacgcggacggcgtcattgtaggaagtgccattgtgaaaatagccgcaaaatatggaaaaggctgcgtggagcctgtctgcgattatgtaagggaaatgaaggcagccatttccggctgacagccggttttggatgttttccttgacaagactaaaacagaatgctacactaatgaccacaagagggagctcgtaggcgggctgagaggaagtaatcaacttcgacctttataacctgatttgggtaatgccaacgtagggattcatacgggacaattgtattttccgagcctatacctgttggtatgggctctttttgcgtgagcaataagccggacaaatatgccagcatattcatccggcagattcccttacaatccctccgttaatcaaaaggaggaacaaagatgaattacaccacacaaatggatgccgcaagaaaaggcattctcacaaaagaactgatggaagtggccgggcaggaacaatgggagccggaaaagcttcgggagctggtggcccagggaaaagtcgccattccggccaacaaaaaccacacctgtttaaagcccagcgggatcggatccatgctgaggacaaagatcaacgtgaaccttgggacctccagggatttaaatgacttggaaatggagcttcaaaaagtaaaggatgcagtacatatgggggcggaatccattatggatctaagctcctttggagatacccggaaattccgcaggaagctgaccggggaatgtccggctatgatcggcacggttcccatctatgatgcggtggtttattaccacaagccacttcgggaaatcactgccgaagaatggatccggatcgtggaaatgcacgcggaagacggggtggactttatgaccattcacgtagggatcaacaggcagactgccagaaggttcaaggaggcaaaacggctgaccaacatcgtttcaaggggaggctctatcatctttgcgtggatggaaatgacaggggaggaaaatcccttttatgagcattacgaccgcattctggaaatatgtcagaagcatgatgtgaccttaagccttggagatgcctgccgtccgggttgtattgaagacgcatcggatatatcccaggtggaggagctggtgactcttggggaactgacaagaaaagcctgggaaaaggatgtgcaggttattattgaaggtcccggccacatgcccttagaccagattgcagccaatatgaaaatccagcagaccatctgcaaaggagcacctttttatgttctggggcctcttgtcacagatattgcgccgggctatgaccatatcactgcagccatcggaggggccatagctgctgctgccggagcggcctttctctgctatgtgactcctgcggagcatttgaagctgccggatgaagcagacgtaaaggaagggatcatcgctgcccggatcgccgcccatgcggcggatattgcaaagggcatcaaaggcgccggggaatgggatcataagatgagcgatgccagaaaacggctggattgggaaaccatgttccagcttgccattgacccggaaaaggccagacgctaccgggccatgtcaaaaccggaaaaggaagatacctgctccatgtgcggcaatttctgtgccatgaaaaatatgaaccggattcttgacggggatattgtagatatttttgatgaatgacatagcttatccgaacttgtaacccaagtgaggataaaaggggcgttctatttctaagcggatattcgcaatgaccatggggcacagcggccccgtaccatttggtgggcaccccgctttgcaactgatttggtttaattacataaacaggaggaattttcatgaatgatcaaataccatcaacaatttataacagttcttctgcaagttcaaaagtgcggttgaaaaaactggtgatcagcggaatgctgacagctcttaccgttgccctctccggtttttccatccctgtgggagcgtccaaatgcttcccggcacagcatctggcaaatgttctggcaggagtgtttctagggcctgtatacggcatttccatggcttttggcacttctctcatacgcaatctcatgggaaccggaagcttactggcctttccgggaagcatggttggcgcattttgcggggcttatctgtttcaaaaaaccgggaagcttttgcccgcttatcttggagaagtgattggcacaggtctcatcggcgggctgctctgctatccggtggccgcgttactcatgggaaaagaggtggctgtatttttctttgtgattccatttcttatgagcaccctggcaggaaccatactggcagccagcttgctggcaatgctgcgccgccttggcctgttttcctattttgagcggcttatcaatgaataggggaacaggaggtggacttgaaaatcaatgaatccatgaccgggctggtcagaaaaaaacggcctgtcatccactgtatcaccaattacgtcactgcaacagatgtggcaaatattattctggcctgcggcggttcccccattatggcggaccacctggatgaggttacggaaataactgccttatcaaacgcccttcttttaaacatgggaacccccaaagagaatgcagcggcagcaatggaaaaggccggactggaagcaaaccggttaaacctcccagtcatctttgacccggtagggatcggcgcctcccgttaccggactgaaacagccctttcacttttaaggaacgtaaaagcaaccgttatcaggggaaatgcctctgagcttcgggtcctgttaaaggaactgaccgggaaaaacatgcaaagagaaaacggctctgttgcctcaccacggggagttgacgcttcctttactgatgaaataagggaagaaatcctggaatctcttagggaaacagccagggccttaagcgctgcaaccggtgctgtggccgtcatgacaggggcaattgatattgtctcagacggaaaggaagcctggcttatcaggaacggctgcccccaaatggcccggatcaccggaagcggctgcatgctggatggcatcattgccgcctattgtgctgcggccgggcctgcattctcacagcctgccatgttccaggccgccgctcttgccacggctgctgccggtctctgcggggaacttgcggcaaaaagggcggaaaaaatctccggcggcacaggcagcttccactgctgctttctggatcaggtaagccttttggatgaaaacaccttaaaaggagggatagacattgaaatttcgtaaggacatgcttttcctgtatgctgtaacagatcagggatttacgggagaaaaaaccttgacagaacaaattgaagaagccctttcggccggagtgacccttctccagctccgtgaaaagagcctggacaaaagtatctttctggaggaagcccttattgtccgggagcttaccaggcattacggcattcccctcatcataaacgatgacgtggaaattgcccttaagtgcggtgccgacggggtgcacgtagggcaggatgatttacctcccttagaggtccgccggttaatcggaccggaacgcattctgggtgtcactgcaaaaagcccggaacaggcaaaaagggcatttatggaaggggcggattatatcgggtccggtgccatattcccaagtcccacaaaaaaggacgctgctgccttgaccttggagcagttgtctgccatctgccgctctgttcccattccggtaacagctatcggcggaattaccggccaaaatgtttccagcctgaaaggaaccggtatcgccggggctgcggtggtttccggaatctttgggcaagggaatattacagcagcagtccatggcttaaaagaacagcttttaaaggtggtgagcctatgagcctgattctcccttctttccttaccattgcaggtacggatcccagcggcggcgccggaatacaggcggatttaaagactgcggcggctcttggtgtctatggctccagcgtgatcaccgccctggtcgcccaaaatacgactggggttttcctgacggaaacagtcagtcaggaaatgcttgccgcccagctggatgccgtatttaccgacattccgccaaaggccgtaaagatcggcatggccggaacttcccggtccatagaaatcattggggaaaaactgaaaaactataaccgttctcctgtgatcctggacccggtcatggtatccaccagcggacattctctgttaaacccacaggatgttaagactttaacaagcaagctgtttcccctggcggctttggttacccccaatataccggaggcagaggcacttttatccacaaaagggcgccggatatacacagaaaaggatatggaagaggctgcaatggagcttttccacatctttcagattccttttcttttaaaaggcggtcataatacacagggcgccgacgatgtgctgtgccgcaatggatttataacctggtttccaggagaacggatccacaatccaaatacccacggaaccggatgcaccttatcttctgccattgcctgcgggctggccaggggcatggggctggaagaaagcatcctggcggcaaaagcctacttaaacggagcactgaaagccggcttaaaaatgggaaaagggcggggtcccttgtggcatggatggagaacataaccataggaaagccggaacgcatggtgtatcgcgttccggcttttgccaactcctgcaggacaggccttattttcccgttttatctgctttccagtttcctgtaaagatcaatgatctcttcggccatgaccttaaagacctccgcgctcatcatctgatcctccgcatgggtcagaataagtcccatgggcactgcttctcccgccgcttctctctggattaagtccgcatggggcaagtggccctgcttcatcatttcgtccccttctgcgatcagatgttccgcttcttcgtattttccttctttcgctttttgtactgccttaatatagtttgattttgctccgcctgctgcagtgatcaaccgaaagcaaataagttccatttcctgcatctttccaccttttctctctgcacagaaaccatcaatcctggacctgatgttcctgcttttcatacattttgtcaatcaccctgataaaaggaagatacacgaagaatgacaatgccaggatcacaacctgaagcagtgccgtcctccagcctccgatgagaaatcctgaaataatgggcggacacgtccagggtaccagaattcctttgtacatggggcagagtcccgtataaatcgccagatactgaatgattcctgataaaacaggcatcagtataaatggaatggccataatggggtttaacacaatgggtgtgccaaagagcaccggctcattgatgttaaagcatgcaggaccgatccccagcttgccgacctgcttgcactgagtggacttggcaaaaaatgtaaggtatatgaccacaccaatggtgattcctgcccctgtaaccgtcataaactgatccagaaactgctgggtaacaatatgtccgccgtttgccagtgtaagctcccggccgctgtcaataattgcctggtttgcggcagtgtttgcggtgagaatgggtcccataattccccccacaagcgtggagccgtggattccgaagaaccagaaaaacggaatcaaaaatcccatggcaaccactcctccaaatgaatcggtcaggccctggaggggaatctgaatggttttatagatccactccatcggggtcgtgccaaacacattttttacaatggcatacatgatggaggctccgataataatggcagcgcccggaaccagagccgtgaaagaagtagccactccgtcaggaactccttccggcatcttaatggtaatgtttttccttaaaaataccgtatagatccagcctgcaatgagtccgatcaggatcgcaccgatcataccctgcccgccggtccaggtcttaaaaataactcctactgaagctccctcctggttagttacagtggaaggctgaagcagcagataggtacacagggagatcaccccagccggcattccgttgtatccctcatttttcacataagtataggcaatgccaatggaggcaatcaaagccatgatattaaaggtgctttcaaaggcctgattcagcaccggtgtaatgccggcggccttaagccagtcggcaaaaggcgtatatggaaaattcgccagaagcagaaaaatagaaccgatgatcatcatgggcatggaatacagcagcccatcctttaaaccacgaattgcctttgtattgataaacaccattaactttggaaccactttattatttaaaaactctttcatcctcactgtccctccctttctcttctcatttaccggccagcttccgggcaaactccagaaccttttttccattgcacatgccgtaatccaccatagggatcacatccaacggaacctgatgatttttacaggtcttggaaaccttgtcctttaagtaccccacctgaggtccaagcagcgcgcagtccactcctcccaggttttcatccaggtcattgaccggatatgcagcgatatccgcctccagtccctcttccagggccgcctgcttcattttactcaccagcaggcttgtggacattccctgactgcaaaataaccgaatctttatcatatattttcctcctataattcctctccgtttgattgaattaccttctggaaccagtaaaagctttctttcctgcttctctcccctgttcccttaccctgattgtccttatccacatagatgaatccgtagcgcttttccatctcccctgttcctgcggaaaccaggtcaatgcagccccatggggtatatcccattaagtccactccatcctgttccacacattgtttcattgcttctatatgcgcctttaaatattcaatccggtaaccgtcatgtatcatgccgtcttctccccgctgatcataggcaccaaagccattttccacgatgaacagaggaagtccgtacctgtcatacagccagttcatggtgtagcgaagcccttccggatcaatgggccatccccactggctggccttcacataaggattctccacccggtctcgaccttcacggtaatcatactccggattatcgtccctgtgctttacggtaaaggacatgtaatagctgaatccgatataatccacacatccttcttttaacgcctccaaatcttccggccttatatccaggaccagccccttccgcttccagtatgcctttatgtattccgggtacttccctctcacatggacgtccgcaaaccagcagcgcttctgcatggaagacatggacatcatcatgtccctgggatcacaggagtaaggataaatggggcacatggccatcatgcagccgatcttaaagtccggattgatctcatgccctgcctttactgccagggccgatgccaccagctcgtagtgggccgcctggtacattaaatgttcccggttatccccttccttaaaaagaagccctgagttggtaaaaggggcaaagtctccgtcaaaatccgcctggttattgatctcgttaaaggtcatccaataagtcaccttgtccttataccgttcaaagcacactttggcaaacttcacgaacagctccgtacagatacggtttctgaaaccgccgtacttgacaaccagttcatagggcatctcaaagtgagacagggtcactaccggctggattccatactttctgcactcatcaaataaatcgtcataaaaccggagtccctcttcatttggctctggttcttcacctccgggaaaaatcctggtccaggcaatggaggtacggaaacactggaaacccatttccgcaaaaaggcggatatcctctttgtaacgatggtaaaaatcaattccctcatggttgggataatactttccctctatgactccatcagttattttccgttcctttccattggctccggctgtcatcacatcggcaacgctgacgcctttgcccccttctttccaggctccttccaactgatgggcggcaactgcacctccccatagaaaatccttactcagcataagtattattttcctccttcaatggtttgtttttatggtagcatcggaacacacaaaactccaacgaaaaaaataccacattcaatctggcagtttttctccagtctgaatgtggtatttttattcttccagcagttccagcaaaacctcatactccggttcctggattaagcgcgtgaccgcctccttattaagggcaaaccgcgcggtggtttcatagaaggtctggcggtttctgtcctctttccttcctatggaaatcagcagaaccacctggaccggaagtttattccagatgacaggctccttgagaaccgccacataagcaaaggtttcctccgaagcgatctggttagggtgagggagggtgatataattcccataatccatctgggcaaaggtttcccgctcaagtaccagctcataaaaattctcatccaccttttcctgcttcctgatcacgccgcacagaaactttaatatttcctccttatgcttcccatccaccgacttaagcagccgcacaggtgtgtaataccgctttatgatccccctgctgtttccccttttaagggtcctggtgatcttctggatatcatccgcttctaaaaacgcccccacttctacaatggggacaggaacctccatggtaattggcacggtggaaaaaatgtaatcaacattctggaaatcaaaatgttccagctctaagagatcacagacatagatatttcttaaataaccggaaaactcactttcatatttgtatttcaataaccgggagcttccctttcccgtgctgcataccacaagaatatcagaacatggctccatcttgtccttttccagggcaagctgaaagatcagggcaaaatatccgatctcatcctcggaaatatcctttttataatgctttttcagcactcctaccgcttcataggatatctggtatgccagacaatacttttgcttgatctcttccagaatggggttttttaaaggaatatcataccggatcctgatatcaaagggaaccagatgctgatttaatgtcatccgtatttcaaaattattatgcatttccagcccgtattccctgctcaccagttccatcatggccagggcaagctggtcggtctgctctctgataacaaaattggagtcattttccagtgtgcttccgatcatccgctttcccgccagatacagggaaagataatgttcctcgtcagcagtataggtgatctgttcctgggcctctaccacggaaataagctcctggatgagtgcagattcctttccccttatttccggtaagtttttcttttccatctgaagataaaagcctgatctcatccgtttccgggccacataggtatattccacgaaattctcaaaagcgatctccgaaaggcggatcccgtacttctttaacaggcccttaatgacttccgccaaatggaccagctcgctttcctgatggctgatatccacccctgtcagactttggcgtttgataaaataatcgcttaacagcctgcggatatcaaactcccagcctttgatcctgattccgtaattgggtttcctgtcaatggaaaggccgtagcgttttaatatcccttccactgatttaagagaattggacaaggtggattttgaaacatagagaaaatcacaaagctcttctatctttatataatccattctggaaattaagtatgcaagcaaatattctcttctctcgatttccctctccggaaaatattccgtcttttctgtttcttttttgatatatgcatcatatttctcctggtcatgaatccgaagtatatacccaaacctcgcttttgagcttatttccgccccatggccttccagcagtccgcttaaatccttcagtctcagccgtaccgtcttttcactgaccttcagccgttctgccaatgtcaaagccgttctgtattcttcctgactcaagagcatcagcaattcctgcaactgtttccaaagcatagccgtctccttagcactttttgtcctacaaaaccttattatcagcataacatggcaggcataatttttccatttagatttttaccacattaattctggtaatcggaggcgtttcgggctgcaatcctttctcccccttctctcagcttgaacctgttcaccaggctcttcagcatctgcgcctgtcctgaaagttcttcacttgccgccgcactctcttccgatgttgcggaattggtttgcaccactgccgaaatctgctcaagtcctgctgcaatctgtgtgacagcataagattcttcttcagaggcttttgctatctgccggactctctcatccacgctcttagatgtatctacgacatcattaagtgactcggcagccttatctgccagccttctgccgttttgaatggcctccaccgtgctctcaatcagtgccgtggtattctttgctgcctccgccgattttcctgcaaggctgcgcacctcatccgcaaccacggaaaaccctttgcctgcttcgccggcacgggctgcttccacagctgcatttaaagcaagaatattggtttgaaatgcgatgtcatcaatggttctgataatttttccgatctcccgggaggtatcggtaatttcctccattgccttcatcagctgctgcatgtgctggctgctttctgcaacctccccgcctgcttcccctgacaaatggcttgcctgccgggcattgtctgcattgtctttgatcctctcagaaatttccgttatggtagacgtaagctcttccacggaacttgcctgctccgcggccccctggcttaggctctgagcgctgtctgatacctgcccggctcctgccgaaacctggtcagaggcagagttgatttctataagggtattgcttaaattgctgcgaatggtccgcatggcggtcaatatttcctgataatcaccgatgtatttttcctcgtatttcgtatcggtcctgaaattgccttcgctcatttctcccagcaaatagttgatgtccagaatgattgcctttaaattttccgccatctccaaaaaggtcctggaaagaactccgatctcatcattgctttttgtatccacctgtatggaaagatgtccggaagcaatttcagacgcagcagaaactacaccgttgataggccttaatactcttctgagaataatgataacaatggcgaccacagccaccatggataatatagaaaccactccgattgtaaccgttaacatgttaatgtctttattcaagtcagaagtatccaatacggtctgtgcccaccaatgggtcccttccacatcaatgggatagaaaaaccgggatactttatgccctccttcacggacagtcgtacatgtaaaagcctttcccccggcagctccgtccgtgatcttattcacatcctccggatcctttataagctcagaaagattatggccaatggaatcagcagatccgctgtcatataccgtggtgaaatcatccgtgagaatgctcacgtaaagggttttatattccgcagaagatgtggttattttgttaaaatgtccaacgtcaatatcagccacaataactccctgaaactcatctttatataaaattgggtataccgcagtgatcatggtagtgccctgatactggtcaggctttgtaaaataaggttttttggtttcctttgcaggcttataatattcctgttcgctgtaatcgctgtattttccaaagggctttgccactcgattggccgcatcctcccggttcacatatagggcataatcctgtatgttgtcatcgtacttgcctggttcaaaaaagatgccaaatcctacaatatcctcatcagctgcgacggcagagcacatgctgttgatcagataattttccacttcaacgcttaaatcagccatttccgtgtgatataccgcactttttacctgggcattctccgaagaagagataaccgctgttccctggtcatgctcgtttacaatatagtccagcatggccgatgcctgttttgatgcagaatccaggatcgcctgtacctggtttccatttgcgtgggccagattggtaagctccgaccggaccgcaatgctggttgcctgacctgacaggcggacggttacaatacttaaaatcccaaaaaccacaagcaatgcagccgtgatcaccattgcaattttatcagaaattttcctgtatttcttttgctgcatgtttccttttccaattttcatctgtattttcctcgcatcattattttttgaatatgatccttttgacactgtttcagcattgccttaaacttctcatgctcttttttatggatttcattctgaataatttccgcagatccaaaagagacagaacagtccctctcagtgagataatccttgaattatattgatttgatccagacagctttgggattttatcctccttccgttttacaaatatatgtaaaccgcttttattactgaatacttccacttttccatctcctcccctatggtaaatccatgtttttctcatagcctggctgtccctatgaaccgcttatcatttaaacctaccctgagacctcccattctggctgaccgcaaataatgacagcactttttcctgctggttgtccattggtagtaaaaaggtacaccttgatatcactggcaaaatgtaaagaaaataagaataataagtgcaaaatatgttgtattttgtcgaaatagtgcttataatatacatagtatttttatgctgtttctatttgataaaaaggtgtacctttttatcaaataatcaatggaaagaatccctgaattgtatacagaaattcctggttatagcaaccatttctcactcatccggtttccatttttatatattgacctgcaggctgtcgttttccaaatactaatatagtagaataatctatgaacctcatgccataattaagaatgacaggaggttattttaatgaaaaatttttacgggtatatgagggtctcctcattggaacagaatacagagcggcagagagtcgagcttctccgctggggcattattgacaagaacatattttgcgacaaattgtcagggaaagattttaacaggccccaatatcaaaaactaaagcgaaagctgaaagaaggagatgtccttgttgtaaaaagcattgaccgtctgggaagaaattacgatgatatacaggaagaatggcgggaaattgttaaagcaaagaaagctgatattgtgatcctggacatgccgatcctggacacaagaacaaataaagatctcatagggaccctgatatctgatatagtcctgcagctcctttcctatgtggcacaggcggaacgggaaaatatcaaacaacgccaggcagaggggatcgcccttgccaaagcccagggaaagcatttggggcgttttcccactcccattcccgacgaattttacccagtctatgaaaaatggcagaagcgcatctataccctggaaaccgcaagcagggagctgggcatcactgtcagccagttccggacaatgatcaaaaaatacaagtcaaaggcataaccactttaaaacaggcagaaccgccggattttcctggcggctctgcctgctggacagacacactatttcattcatacatatttatgagaagaaagtcatttatgggaatttcggttcccgcctctcaccctggcaagacaacaatcaaatctccgcgttctccgggaccagtctcacttcaaaaacaaattcctcttcatcaaaccggtattctttccgaagctccggcccgcagctagctgatccgatcccatcctggcggtaatccaggcaaaggaccgtatacccggagggtgtcagttcataattatgagcctttcgcgtcaattcctcctgggtataaaccgatgcgttaaaggagaaggtccgtccagaaactgttgaaagggcggttcccctgccttgtatcttcacaaaatcacaatcacttctgcttccattctcctgcggccttaaatagtcctcatgcatttcctttacacaggatgtaaataatccgtggtagcttgctcttctcttatccatgtaattttccaccgggccgaggccataataggtgatctgatccatgctctctggaaggaagagacgaaggccgaatcttggaagctcaggaaattccacatcccgttttacatccagcttcccatctaaaacaccatccgttcctatggtccacagggcttccatggtcagaatcctctgaaccacaaccgcggtgattgacagtgcggtccttatttccaccctcccctcctttatttcccaggaggtttcataagcccttgaaatggcccggtcataacgggcagccagccacttgttttttatatacctgtcattatccgttggcgccctccagatgttatattccatagggcgttccagaagagtcctgttttcaaataccatctcctgaaaacagccggtcagcttgttataggtataggaaaagtttgttccatttataaacaggtaacggtcatcttccttgatcttaaagcatccgccatctctttcctttgtctcctgcctctctgacatgcaaaccccggtctggtttctcatatcttcattttcaagcagtacctcatcaaagcctaaaaagcttcctgcagccaaaaaagcgctgctctgctttaataaataattgacctttaaataacaagctcctttttccggaactacaaaatctaaagtcaggcttcctttgtcatgaggctttatctccggcatatccccctcaccgatcatcccttttgcaatgatctccccgtcgcaggtcacctcatatccaatgaccgcataatcctttaaatcagtaaaatccatgcggttatgaagctccagctccttcttttcctgatcaaaagaaaccagccttgccggacggtacacatttttaaattccatcagccctgtatgtggcctccggtccggatacaccaggccatccatgcaaaaattgccgtcatgagggtattccccgtgatctcctccataaaggtacataggctttccgtccagggtccttccctgatatatggcatggtcgcaccactcccatacaaagccgccgcaaaccccgtcatactggtcaaacaccttataataatcctccagatccccgggcccattgcccatggcatgactgtactcacataaaataaacggctttcccgcatttcttcccatatactcatggatttcctccagcttgggatacatgcggctgtacagatccagattggaaaaatcatattccttgctcttgtcccggtaacgggctgcctcataatgggtgagcctgaaaggatcaaaagcttttgtccaggcaagagcagcctcaaaggtacagccataggcgcactcatttcccatggaccagatcacaacgcttggccggttcttatcccgttccaccagaagctgcgcccggtcaacggtcgcctgggtaaactccggattatctgcaatggcccggttccagcggtcatgcactgcctctgcggaattgtcctccatgtaaatggagttggtaccgtggctctcattgtcagcttcatcaatgacatagaagccgtactcatcacacagctgatagaactgaggtccatcaggataatggctggtgcggatggcattgacattgtgctccttcatgatccttaagtcttttttcatctgttccagactgatgacaaagcctgtcacaggatcgctgtcatggcggttaaccccatgaaacttgatcttttccccgttaaagtaaaccaccccatcctttacggcaatctcccggattcccaggcggtccacaatcacctcattcccgcattccaggaccaccgtataaaggtaaggccgttccgcattccaaagcaccggatcttctatggttataaatatttttccatcctcaagtcctccctcatggccggtgatcagatttccgctggaatcatatatcattgcccttatgggaatctcttttcccaaaaaggtgacatctgcctgaatatgagcctgatccccctccaaagaaattgttaaaaaataatcaaagatgcagtcctccggcctcttcaaaagatacacatcccggaaaatgccggtcatgcgaaacttatcctgatcttccaggtaacttccgtcgcaccattttaaaaccaggacagccagggtattttctccctcccggataagccctgtcacatcaaattcgctggtggaatgggatacctggctgtatcccacatagcttccgttcagccagacatagaaacaggaatccacgccttcaaagtttaaaaaagccctgggagcattttcatccctttcatagacaaaatggtgcacataagccccgcatggattctcagcaggaacatagggcgggtccatgggaaacggatagcgtacattggtatactgatgcctgtcatagccataattctgaaagcatcccggaaccggaatatcatcataagttcccttatcatagtcttccagaaaaaattcatctttcacatcataaatgctgtcaaaataacggaatttccacaccccgctcaaaagctcaaaccggtcagattcctccctgtgctcaataaggtcaaagcgcgccttagaggcaggaatatagtaagctctgtttggcatggtattttcatgaagcaggtgtaaattttcataatgtctgggcacgatcatggtcagttcctccttttttattacctttcattatagaatgaaaggtaataaaaaacatatctccaattagacaaaacatgcacaaaatgatactgttaatcttacagctcctcttaaaacaataatttttgcttaaaatcgggattcttggaacttttaaccttaccaacaactactacttaaatgcagtcagaaaacaatatgttctgctttgtaaatagcggggtctgaaattccggatacctgctttttacatcttctattccagcaaataccttttggttttccgaacatatatttgcataatagccttaggagttggagacgttgtcaaatgacagaagtatgcagccctgcagcgccctatcccaattcggggcagcgatactgactttccctattatcctattcaataagaaattttcataacaaaatctgttatgcataaaatatattacatatctgttaaaacaggaaaggaataatcttgttaaaagtaatagacgataattattatgacttaattgtcaacaatggtactctctcatcctataatgaagatgatattacattattgaacgaatttcattctttgatacatgtggaaaaatatgaagcagattcttgcagtctggaacagggtccttatgcaactcttccaaaattgttctcacttacatcaaccattagcattgaaaagtctggtatggcagatgttcaaagggaccccaattttagtttgttcggccaaggggttattgttggtattgtggatacgggcattgattatcaacacccttcattcattaacaatgacagaactacccgcatcctgtccatatgggatcaaacggtacaagaaggctcccctcctcagggctttacgtttggaacggagtacagcaagaattatataaataatgctttaatatcgagaaatcctttatccgttgtcccctcaacagatactaatggccacgggacggctattgccagtattattgccggtaactccaatccagagctgtctttttccggcgttgttccaaatacagagctggtaattgtaaagttgaaacaagcaaaacaaatcctaaaaaatatcttctttgttccagaagattccctgtgttttcaagaatcagatatcatgctcggactacgttacctaatgactatatctcaaagaatgaaccgccctctcgtcatatgtatagctctggggagcagtcagggaggccatgatggttttggcccgataagtatttatctggacagtattgtacgattacccggcataggaatttctgttgccgccggaaatgaaggtaataatagcagacattattttaacaataccgtttctgagcctttctacaacaacttcctcttaaatgtaggaaataatgatactcgtttttcaatggagatctggccatatgccccacaaagactttccatcgaaatttcgtcccctgatcttgagatcacacagattgtttatccatcatccactgaatgtcaaagatttacttttaataatagccagagtatagtttgggttaacaacatctcttttgagagcggtaccggagatccagtaatattaatacgattcgaaaatcccattcccggaatttggcatttccgtgttcgaaacaatgagaatgagccgttttcttttcattcctggctcccttctggagatttaatatcgaatgatacatttttcttagaggctaatccaaatactacaataacttcgcctggaaataccatgagtatattaactgttaccgcttataatcagcttataaataatattctcattgaatctggaaggggttatacaagaggggggctgattaaacccgatatcgccgctcccggataccaacttccctgtgcacttcctggaaatcaatatggaatgcttaccggaacaggggccgctgctgcccatacagccggagccattgctatgatcttagaatgggcttatgttaaaggtaattttaccgctattaccggtactcaaattaaccgggtaattatacgcgaggcccaacacaacattgcatatatctatccaaataatatatggggatatggtcaattaaatatatataatgtattaaatctattatccagtattatataaatttgtacttatagtaccattttacgccaaatgggcgggcccggaataacggagcccgcctatactttactctgcccgtccatgcctttgctttctcaatcaggcattttacaacgttcatagattcctccaatcgaaaaaagcccaggattgtcccggtctatcgccttcacaagaatggccggaagaggcagtcccataagtccagcattctccacgatggatatgaactcgtttggcaggaatcctataatgaccgcatctcttatgcagttggtctttgtctcagtacccttctggaagatcccggtatcccagatgccgcctgacaaaaacatggtccaatgataacggccacgaaacgccagctccatgcctgcaatgcccctttgtctaatggtataaccccgtatatttttcgccatacctacgcaagcgactgatataaagctgggcagattttaagcaggcacaataccttcttactcattcttagatccgtactatgcgtggtacatacatacatttcggttatgcggatgtggaaaaggattttatcccattagacaaaacatacacaaaatgatacaatgttcacgaaagcaatgagcagtgcgaaacaggacccatggaaattatcgttgtgctggcacataagaaaatttccatgggtcctgtttcatagagcgaaagcccgtgagcgggtgaagccccaggcttcacccgctgcactgcggactagcggcacctcatatcccgccgctgccgccccctccaactttgtcaactatcacccattaccccaatctctacccaaaaataaataaaggagcccacccatatgtacaccaacaccggctacatgaacgaaaccgacgaagaactggaagacaccactctcccgctcaaagcaaacagctgcggcgtctaccgcctgatcacccgcccgatcatgtccaccatacgcccctcaggccgccctgattaccagattttatacattgcgtcaggaaaagcctggtttttcttccaaaaagaagccctacaaatccccgccggaaatatggttctctacaaacctcatgccccccagcaatatgcctactacctaaaagacaaaccagaagtatactggcttcatttcacaggcagggaagccgcccattttaccaaagaagcaggctttgaaaacaataacattttatacaccggcgtatcctccaaataccaggaactgttcctctccatcatccgggaactccagttcccccgcccctgctacgaggacctgacctctctttacctaaaacagctcttcctccttttaaaacgtcaaaaagaagaaggcggttccccaaaaacggacatccaaaaacaaatggaaaaagcagtccgctactttcaagaaaacttttccgctgaaatcgaaatcgaccattacgcaaaaaaactccacatgagcacctgctggttcatccgaagcttcaaacaatataccggtatgcctccccgcaaatacttaacctccatccggataaaaaaggcccaggaacttctggagagcaccgactattgcattggagaaatcggcagcatcgtcggctacgacaaccccctgtatttcagccgtatcttcaaaaaccaaaccggcattccccctgcagaatacagaaaagcggcaaggtgagcacataaacatgctcactgccgctcccccctatctccctaccaaccggtaagtctggcggtattccttgggtgtaattcccatataccgtttaaaaatccttctgaaataatccacatcctgataaccgcattgataggcgatctcatttcccgtcaaattcgtctcaatgagcatcctgcacgccttattaagcctggcttcatgaatcccctctgtcaaggtcttcccgtacaccgcattatatacacgtcctaagtaatccgggctgcagtccagcttgtcagccaatatggaagaggacagcggctcctcaaaatgattccggatatactgccccgcccgatttgccaacagcaccttctgcccattcacttccatgggcgaaagggaatcgctcaactcacacagcagctccaaaagcaccagatttaaaatggtccggtcatccctgcaaacattctgccttttaataaaccggcggaaaagctcctcaaactgttccggctttctgatacggatgagctgggcagggacataatatcccgtccgattctcaccgcctcctcttccagatgaaaatggagccagtaaaaattcaaatcctcctcaaactctcttgttccccagtgatgccttcccggaaacaggatcagcgcttccccttcttccacattataggtgatatcctcttccgcaatccccaaagtaccggaatttacatagatgatctcaaaggaatccatgacccggtccgcatggcgtccccgcccgccggtcaccagataccctgcattcagcgcccgcaccggaagcacagcctttagatgtaagtgatgttccatagttccctcctgtggcccgtgtcggaatcctccagtttttcacttctttttcctcttgtatccctttcattatgctggcaatatagagagaggaaaaaacggtgtttttctggaaagaaggagactttaggcccgtcctgttttgcactccttttaacaaagaatatcagatatcaaacaaaaagaaaaggggattgtggcaattctgccacaaaagttcgatgatagaagcagtattatttttaaaagaaaaggtgtcccgcacctattttaacggaaccaccctgacagaaacggattattccaaaggcagaaagctcttcattgcagaaggctgctgcgccaacggaatcgtcaccctgaccaccggagcattcctttccggatatgccaattcactgggcgccactgattccatgaacgggatcatcggttccattccggtccttctctgcacccttcagatgttttcctccatccttttggaaagcctctgccgaaaaaaatgcttgatttccagcttttcctttatccacaggcttctcctggcttcggtattttttgtgcccctgtttataagtggtcccggactccgcctggctgccgtgatcgccatttatgggaccgcccactgtttcggagcctttatcggaaccggcacaggcaactggctccttcagctcgtcccccagcacataaggggaaattatctgggaaaaaaagattcctttgcatttgcattttctaccatcctaagcctgatcatgggctgggtcatggaccagttccgcagctcttccatggagcagaccggctttctggtggtgggaatcgttgtcttttttgtggcctgtacggacttttggtgcctctcttccatcagtgaaccggaaagcattccccaccgccagaagcttcaggacgcggtggtaaagccgctggccgacaaggagtaccggaaggtcatgctcacttacatgttctggaacttagcccttcagatcgccggcccctttttcagcgtatacatggtcacaggacttaagctgaattatacatacatcacctttttaggccttatttcctcaaccgtcagggttttggccgcctggctctgggacggctggcagacgccacatcctggcttttggcagcccgctgctccatgggaatgctgggccttgttcatgccagctggcttttcatgacacctgaaacctgctatgccctacagcctgtgctccaggcattatccggcgccgcctggggaggtattgccatatccgtcttcaatctccagtatcactatgccccagcggagaagcgtgtgctatatgtcagcgcaaattcctcctatgcaggactttgcggctttctttccaccctccttggcgcctcgcttttaaaggtatttccttccctggaaattggcggattccccataaccgggatgcagctgctctttcttctttccgggatcctgatcctgggatgcgttttttacatgggaaggctccgctctgtttccatttaaggccgccggtccctgcaggattcccggatgatcagctccggctttaaaatccgctccaccttgctttcctcatcagggatctggttcatcttttccaaaagaagctccgccgccatggcccctaagcgctcctggggtgggcgatagttgtcagctttaccagtccgttttctgcaataaaggaattgtcatagcctgtcacggaaatatcctggggcacggaaagcccgcttttttcaatggtcttcatcacttcaaaggcaatctggtcattgtagcagacgattccgtccacaatgactccttcttccagctttagccttaaagcacccgatggctttgacgtccggtcctccgtatggaaccagaccaccatatccggatcataaaaaaatcctgcctcctgaagggcctttacatagcccttgtggcggtcccttccctggctgtcatcggccttgaatatccccagaatgtgcttgtgccccaattggatcagatgctttgtcaccagatacccgcccatacagtcatccatcagaatatggggcttgtttttcatgtgggcataacagccctgaatgaacacataagggatctggtaaaaatccagcttgtcataaagtcctttatggccgcacatgatctcacttttacttggttcaatgatgagcccgtcaacgtcctttcccaggatttcttccaggcacttgctttccttcagcctgctgttccccgtattttttaatatgatgctgtagccgtttgccgtgagcacgctgtcgatcccctggatcagcctggggaaaatgtaatctgataagtaggtggtgatgactgcgatgttccctgatccttttttccttcctgccttcctggaaacaaaggttccacggccatgctctgcctcaataaacccttcctgttccagaatggacagcgcttttctcaccgtatgacggctgacatggcaggaggccgacagctcatgttccgaaggcaggcggtcccccggtttccgctttcctgaaacaatatcctttttcagttcttccattaacacataatactttgcctttccgctgtcttcggccataggttgctccttatgattcctttttctggccgtaataggcattcggcccatgcttgcgcataaaatgcttatcctgcatgcactggggcgccggtaaaaccgaagggtttaaaatctcggtcatcagattcattttagcgatctcctccagcacaacggcgttgtgtactgcatcggccgcatcctttccccaggtaaagggcccatggtttttgcacaaaaccccagggacgtgcatgggatttattccctggaaggtctcgatgatcacggttcccgtattcttctcatatccgtcctcaatctcttgttccgtgagatttctggcacaggggatttccccgtagaaataatccccatgggtggtcccatagcaggggattgctcttccggcctgggcccaggctgtggccatgggagaatgggtatggacgatcccgccgacttccttaaaagccttataaagctccagatgggtggccgtatcagaggacggccttaattttccttccacctggttgccttcaagatccatgaccaccatgtcttcaggggtgagcacatcataatccaccccgctgggcttgatcacaaaaagcccctgatcccggtcaatccgctgacatttccccaggtataagtaataagcccccttttcggcagctccatgtttgcatcgtatacacgctttttcaattcttccagcatgtcagtttcctccttttccattccggaattattttaagctgtccacagcagcacgctcaatggaaagcccgtttctgtatcgttccataaatacctgaaagcctgccgcatcttcaggatcaggctctaacctggttcctccgttggtcttaaacactttttccgccagataatgatccaaagtctccccttcctctttccgaagcatgaaagaagccaaaagagcggctccccaggctccgccttccccggctgtctccataacggaaaccggaacgccaacggccgctgccatgatccgctgccccacttcccttgtcttaaaaagccctccatggcctaaaagcacgttgagccggaccccttcttcaaacaggatatccattcccatttttaaagctcccagggccgtataaagatggactctcataaagttggaaagagtaaagcggctttccggcgtccggatgaacacaggcctgccctcttcaaaatgagtgatatgctctcccgataaatatccgtaggaaagcattcctcctccatccttatccccttccagggctttttggtaaagggtggaaaacagggtgttcttgtcagttttcattcccatcgtccctgcaaattcctcaaacagggaaacccaggcgtttaaatccgaggtgcagttgttgcagtggaccatggcaaccatgtcgccggcaggagtggtgaccatgtcaatttccggatagactttggaaagctcctgttccagcaccaccatggcaaacacgctggtccctgcggatacattgccggtcctttttgccacactgttggtggcagtcatccctgtccctgcatcaccttccggcgggcaaaggggaatgccggactttaaattaccgctgggatcaagaagccttgccccttccccggtgaggattcctgccctctctcctgccgtcatcaccttaggcatgatatcccgaaacttccaggggaattgatggggagccaccagctcatcaaactgccggatcatgcgcccatgaaagtcctttgaagcgctgtccacaggaaacatccccgcacagtctccgattccaagaacccgctctcccgtcagcttccaatgaacataaccttccagagtgaccaggtaatcgatccttggcacatgctcctccttgttaaggatcgcctgatataaatgggcaatgctccatctctggggaatgctaaaggaaaacagctttgtcagcttttccgaggcctcccctgtcatggtatttctccatgtccggaaaggaaccagaagctctccctccttgtcaaatgccatatacccgtgcatcatggcggaaaagcagatggcccctacggtggtaagcgtttccccatacctctcctttacctcatctgccatattcttatagctctcctgtaacccagcccagatatccgggatggaataggtccagaccccgtctacgtactggttttcccagtcatggcttccggaagcaattgggttatggtcttcatctaccagtacggccttgatccttgtggagccaagctcgatccccagggcggtccttccttcccggatggcagcccctatttgtttttcattcatttgaaacccctcctgaatcacgtccgccactttccttacagaaagggcggactgtgttatttgtttaacgaaacgctgctaaattccatctcagttcattttttaaatccctgatggtagttttttcatcaatgaaaacagcttcgattcccatggcctccgcccagtctcccatctgctctgccgttaagtcataggaaaaggccgtatgatgggcgccgcctgctaaaatccagctttccgctcctgtggtaaggtttggctcaggcgtccagaacgctgtggcgaccggaagctttggcatgggcctttctgtctttttgcagtttaccgtattgatgatcaagcggaatcgggttcctaaatcaatcagagaggtggcaactcccttcccctcctttgccgtaaatacaaggcgggcgggcgcttccctctctcccattgacagcgggttcaccctgatcccgatttttccgtcggcaatggtggggcaaacctccagcatgtgagcctgaaggatcccttcctttcccggaaccagattgtaggtgtaatcttccataaaggaggtaccctttgcctcctttgtcccctgggtcatgagcttcatcaggcgcaccatggcggctgtcttccagtctccttccgctccgaagccatagcccttttccatgaggcgctggatggccaggccgggaagctgctttaaggtgcctaaatcccgaaatgggttacaatggcctgataatccttatcctttaaaaaccgttcaaaccccagttcaatctgtgcctggacagccacatgcgccttaaactcctcctggtccatgccttccgtcaaaatctcgtatctgctgtaatactcctccacaagagaagaaatatcgcctgctgccacgtcctttacatagtctgtgatctcattgacaggataggcgtcgatctcccagccgaatttcatctgggcctctactttgtctccttcggtgacagctacatttctcatgttgtctgcaacccggaccacccggatgtggctgctttccatgatcccaactgcagtcctcatccaggaacctatccggctctggacgctctggtcatcccagtggcctgcgatcacctttctgggaattcccattctggtgaccatatgtccgaattcccggtccccgtgagcggactggttctcattcatgaaatccatatcaatggtatcataagggatctccctgttaaactgtgtgtgcaagtgaagcagcggcttcctgtattcctgaagtcctaaaatccaggactttgcaggagaaaaggtgtgcatccaggtgatcactcctgcgcaggattcatcagtatttgcctcatggaacaatctgcgtatggaggtgttatcgatcagcaccggctttaaaaccacctcataaggaagaagcccggaagcgttcagtctatcagcaatgatcctggaatggtccgccacatttcgtaagcattcctcaccgtaaagatcctgagaccctgttgcaaaccaaaatttatattcttttcttatcattttaattaccccctttttccttatttcccaaggcggatcacattccatgacgccttgtgcaaaatacttgtcataacaccgccatctaacagggactggctggtctgccttggaactaccttctcaccaaaaggcccgttttctgcttttaaatcattgctttccaacaccacatgctccaaaacccggtatccttcaaagcttctcacatccactgccatttccccatcatttttcaaatccctgtttaccgcaaaaatagtcacctcgtcaagggcctcattgtatacggaaacagcttctattgcagttacatcttcatgggaagacgtatcaaatttcggcgtggagatgaccggaagaagagctgttccccgtccatatctggaagcatgcataaagggatagaaaatcgtctgcctccatgccctgccgcctcctgcctccgtcatgatgggcgcgattacattcacaagctgggccaggcaggccatcttcacccggtctgcatgttttaacagggtgatgagcataaggcccactaaaagagcgtcctcaaaattataaacgtcttccagcatgggaggtgccacctgccatggatggtttttcgtaatatcatcgtcagctgcattggagtgataccatacattccactcatcaaagctgatcttaatatcctttttgccccgcttcctggcctttacaaaatcacaggtagcgatgacagtgcggataaactggtccatatcgtcagagcatgcaaggaaatcctggctgtccccggcccggttcccataatactggtgcatggatatgtaatccacgtaatcgtaggtgtgctgaagcgtcacggcctcccactccggaaaggtgggcatggtcaaggatgaacttccgcaggaaaccagctcaatgtcaggatcaatgagcttcatagcccttgcagtctcttccgccaggcgtccgtactcctccatggtcttatgcccgatctgccatgggccatccatttcattgcccaggcaccaggttttgatcttatgaggctccctatagccgtggctgatccttaaatcactgtatttgctgctgccggggtgattgcagtattccagcagattacacgcatccgcgatcccctggttcctaagttcactgccatcatcacatcagagcctgcgctcctggtccatttggtaaattcatttaatcccaccttgttctcttccatactgcgccaggccagctctaaacgcctggggcgttcctgtaagggtcccacgctgtcctcccagtaaaagtttgatacaaagttccctcccggataccgaataatcggaacattcagttccctgatcaattcctttacatcttcccggaagccgttctcatcagcagaagcatgctccgggcagtagattccgtcgtatacggcccggcctaaatgctcgataaaggaaccgtagatcctttcatccacctgtccgatccggtattccctgtcaaccaccatttttactttgtgaaacgccattaatataatcccgcccttcttttatgtattaaatacatcattctccaaacacctttttataaacatcctgaaacttcacaattccctggtcagtcaaaggatgccttgtcatttgttccaaaaccttatagggcaccgtagcaatgtctgcccctgcctttgcgcagccgatcacatggatggggctgcggacgctggctgcgatgatttccgtttcaatatcatggccagcaaaaatctcataggtttctgcctccttttctcatgagagtgagtcaagcggatattcgcaacacgcttcgctgcttgttcacaacgcgccctgcttcaccgggcataaccgaatagctgcctgatcaggttaaaatatcctcatactaccaatttattacttgtacgcaccattgcacaagttgtttttttatattttaccacaataaaacggatcttacaaaaaagtcccccaaataagcccgggggagaacgcacaaggaagacccatgttctttctgtatttctatattttttccacaattgatcgaagaagggaagagaatatgcacaattttaattttaaaattaatgaatgtttgttgacactttttcaaagaaatgaggtatattaataaatgtaacccccccaatacattatatagtttttgctacaccccataagaaacgaaataccttctccgaaaaaggaccagccacccagctggtccttttcattatcttttatccttatttttccctttcctattccggcgctgatttaaaatacgctcaaagtctttttccgagccctccgcttttaaccgccttcttctctcttctctccggagagcgatttctctggcctctttctttttatataaataaaaagtccaaatcctccgcctgccagtgcaaggactgcgataattcctgccgcagccagtattcctcctccctttcttccggctgacgcttttccaatgcctgaactggttttcggttcctcaggctttgtctctgtggctgcctgttccgattcctgactcgtgggctcttcgctctttttttccattaaataggcctggcccacctttctgtcattgtaggagtactggattaaggcaaccgccctctccggacttccttccggaagatccgacaccagggttttatccgcttgggaaaactccgctccctggggaagggttataacctgatccggctccaattctaagtcagagggtttataagccgtcccgttgatttccaccggatcttctcctgaggtgtagccggtttcattccctgtcacagggaaattctcaaagcggctgaagccaaattccagaagggcctttccatcaataaaatactgctttggacttccttttaaaatgacggaaataagtcttttaccatcttgctccccataggtaacaagggtatttccggccttaatcagatatccggtctttccggccactgccgaggggcagtaaaattcactatttggatccgttgtctttaccagacggtgttcgttataaatagtaagcccatccgggttattggaggtgggaggaatattgtgactgatggcagaactgatctccacaagctttttattgctgtaagccgcttttgctataagggccatatcataggcagtcacatactgggtatctccgttaaggcctgaaggattgtcaaaatggctttctgtacagccaagactctgtatcttttcattcatcatggcgacaaattcttccctgcttccggccacatgctctgcaagggcattggccgcctgattgcaggaatggagaatcagggaatagagacagtcttccacagagagcttatctccggtatccacatttaatttatttccgctgccttcttccacattgtaaatggaatcctttgaaaaggtcaccgtgtcctcaagatctgctttctccaaaacaatgagggcagttaagattttcgtgatgctggccggcggatagggagcatggatgttctgtccaaatataacggctcccgaatccccgtctatgattattccggcttctgcctggatgcccgtatcagacggccagtccggctttgcatatacggtcataagaaacagctggctgaccaatatgcagcttatcagtacttttatcctccgattcacgtatcatcctcctgacatgaaatatgccctaaagccgcatgagaataaattatacggttttagggcatttattttacttcgcgtaatctgtaactctggattcccggatcacgttgaccttgatttgtcccgggtactccagggattcttcaatttttttggaaatatcacgggctaaaagcaccatgtcatcatcgttaatctgttccggaaccaccataatccgaacttcgcgtcctgcctgaatggcaaaggacttgtccactcctttaaaggaattggtaatatcttctaactgttttaatctgtttgtatatgtctccagagtttctcttcttgccccaggtcttgccgcagaaatagtatccgctgcctggacaatgcaagcgatgagactctgtggttcaacatcgccatgatgagattccacagtgttcagcacgattgcagattccttatacttcttacacaactccacacccagctgaatgtgagaaccttccatctcatggtcaacggcttttccgatgtcatgtagtaaaccggcgcgtttggccatacggatatcaaggccgatctctccggctaacagccctgacaattgggccacctcaatggaatgctttaaggcattctgtccgtagcttgtcctatatctcagcttgccaagcaatctgatgagttccggatgaagtccgtgaatgcccacttcaagggcagcggcttctccttcttcacgcatattggtttctacctctttttgtgccttttccaccatctcttcaattcttgccggatgaatacggccatccactataaggcgctccaatgcgattctggctacttctctacgaaccggatcaaatccggataatacaactgcctcaggggtatcatcaataatgagttctactcccgtaagggtttctaacgtacggatgttacggccttcccttccgatgattctgcctttcatctcatcgttaggaagctgtacaacagaaaccgtggtttctgccacatggtcagcagcacatctttggatggctgtcaccacatattcctttgcctttttctcggcttcttcttttgctttgttgtcaagttccttaattaatttcgcagtgtcatgttttacgtcatcttcaacagattttaaaagatattcttttgcctgttcggaggtaagtccggaaattttctccagttcctgaatgcctttctcatagagagattccacttcggcatttctcttattcagggcgtcctctcgagcagccagacctgcttctcgtttttccatagcctcggacttcttgtccaagttttcttccttgtttaatactcttcgttcataacgttgaagctcagctcttctttccctggtttccttctccagttcattcttagtctttaaagactcttcttttgcctcaaggagagcttcacgcttctttgtctcagcggtctttaatgcttcatctattatttcccgggatttttcttctgcagtgccaattttactttcgtaggtattcttacgatacgtgatggcagcagaccaggcaataaaagcaactactactgatgcaacgattgcaatcaatgcagccgtgaatactgatactgacacaggagcacctccttattagattttcattgtacaacaatacaacactacaattttaaactgttttatacattatgtcaagtatttcgcccctgtttccggtatacttatacacattttccccgttgtcagatatcactataaaagccgcctaaaacatggcttatggcatcgtatgaaaacccttttcttcccaaagcagccatgatcctactgcgttccttaaagtccatctcttccggctttaagcacttctttctcacataggcccttatttgggcttcctcattcaccggctgctctctaaggatctcctggatcacctctttatccagcccttttttttgcagttcgtactggatctgtctttcgcttttccgttccagattaaattccacatacctgcgtccatagtcctggtcattgataaagcggtgctcctttaaaaaatttatggcataatcggcggcttccttgggatatcctccgtcctttagcttccgcctcagttcctgctccgtcttgtccgaggatttcaaaagatagaggaccctctctctggctctttttagtaaaacttcctgcaggatctcctgataggtttcctctgaaagcggcttgccttcctcaattccaaatcttctgatttccccacgataaaggacaagagtaaaatcatcctccagaatgattttactcctgcgcttatcgaggggcacgatctctgtaactatcatatatgccccttattctatctatttttccggccttcataaacccggaggccaaatctttctaaacattactcctgaggagcttcgtccttgcttccttctgccttgatccttttgctttccttggccgcagctccaccggagccctccggcgctgcgctgccttcttcatggagtccatactttatgcggaccttattctcaatctccaggcaaacagccggattgtcctgaagataagtcttggcgttctcccgtccctggccgatcttaacgttattataagcaaaccatgctccgctcttttccacaatattctcttttacagccagatccaggatatctccttccttggaaatcccttgccgaacatgatgtcaaattccgcttccttaaacggcggtgcgatcttgttcttcacgaccttcacgcgggcccggtttccaaccatatctccgccctgctttaaagtctctatcttacgaatatccagacggacagatgcgtaaaacttaagggcacgtcctcctgtggttgtctcaggacttccaaacatcactccaaccttctcacgaagctggttgatgaaaagaacagtacagttggacttgctgattacggctgtcagctttctaagggcctgggacataaggcgggcctgaagacccacatgggaatcgcccatatccccttcgatctcagcctttggtacaagggctgcaaccgagtccacgatcacaatgtccactgccccggaacgtaccatggtttccgtgatctccaatgcctgctcaccgttatccggctgggaaatgtaaaggttatcaatatccactcctatgttctttgcataaacaggatcaagggcgtgctccgcgtcaataaaacctgcaatgccgcctcttttctgaacctctgcgatcatatgaagggcaacggtggttttaccgctggactccggtccgtaaatctccactactcttcccttgggaatccctccaagaccaagggcaatatcaagactcaatgccccagtaggtacggtctccacgttcatattggtgcctgaatctcccagcttcatgacagagccttttccatatgccttttctatctgagtaagggcggcatcaagcgcctttagtttatcatctttattcatgttatcctccaacgcgaacaaatgttctttttctgtttataatcatagtatacttcccggcaaatgtcaaccaatattttatacttctaagcccaatatgcatcacactcctgacctgtggggctgaaaataattttttaatccttaaggatatagcggcgaaacgcctgaaactgaatggaaaggaaggcggattgccttctgactgcaaaactactatagcatatataaaagacggctgcaagctttttaagaaggggcataccaggcagcccctcctttgactttccataaaaaaaatcaaggcttccacgggtacaaattctcccgcagaagccctgataacactcacacatatccttgttacgccaaaagcttctccacatcaagcagcccccagccctgctggttcatgggaagccccagatccaccgcccgttcccttaacatcagctttacgtcccggttgctcatatagggatacttctgtagaagaagtgcgatcgcccctgataccaggggcgttgacatggaggtcccgcttttggtaaaatactgtcccgcttcattggcacagctcatgatccctgcgcccggagcaatgatctccggcttgcagatgcaggcaccggtagggcctcttccggaataatcgatcatccggtttcccataacattgacttctttataatcatcggagcagcccacagtgatcaccttacggctgatcccggggtggtgatggtgttcatgcccggtcccatgtttcctgctgccacacagaccaccagcccgtcatcccaggctgcattcaccccccgcacaagaacagaattttctgtcatccctttttttgaaaaggaaccaactgagatatttacaattctgatcccatacctttctctgttgtcacggatccacttaagcccggccagcacatcagaagcatagccgtttcctttcttatccaaaacctttagcatgatgatatgacattccggtgcaacccccatatacgttccgccggaagcactgccgttccctgcgatgattcctgaaatgtgggtcccatgaccgttatcgtcataggtatcccttctgcggtgcacaatgtctacaaaagccgccactctatgttcaaagtcctcatgaagataaatccccgtatcgagaactgcaactcctattccacgtcctgtatagcccatgccatgggccgcctcacagtgtatcgcttctcttacatgattcacagtccattacctgattccttttttattaggatattccggtttagcccttgaggtttctcttcccccaaaatacaaaagaagatttttagccggaataccatttactttctgtcagtacgtttctataatggagataaatataataagtaaggagatcatcatcatggaaaatcatcaatccgatgccacttttctgacacaggccctgatccgcatcgacagtacggaccccggagcatacgaaaaaaatatcggagaatatattttcaaaagcctgtcttccctgtccatccctgtcataaaaaaggaggtccttccgggccgttataatattatggcaaaaatacagggggaaatcgatgaccctgcccttgtttacatctgccatatggatacggtgaccattggagacggctggacagcagacccatttggggcagaaatcatagatggaaagatctacggaaggggagcctgtgacatgaaatccggtctggcctgtgccctttctgccttttcctccattgcagaagaagcggcatcaggaaagactcccaagcattcctttgttttcattggaaccgttgatgaagaggattttatgcggggcgttgaagatgtgataaaagaaggctgggtaacggaaaaaagctttgtcctggatacggagcctaccaacggacagattcaggtggctcataaagggcgtacctggtttgagatcataatcaccggagtaacggcccatgcaagcaccccctggaagggagccgatgccattgcagccatggctgaactcatttcttccatacgacgcaaaatcggagaatgcccctcccacgaggatctgggcatatccacagtcacattcggccagatccagggtggataccgcccctatgtagtccctgaccgctgcaaggtgtggatcgacatgcgcctggtcccgcccattgacacggcttctgccgtttccatagtggaacaggctatcagtgaagcttccctggctgtccccggaatcaccgcttcctataccatcacaggggacagaccttatattgaaaaggatgaaaactctcccttattaaaagcgctgaaggccgccgcggaagaaaccacaggaaaaccggtttctgtcacgttcttcccaggctatacggatactgccgtcattgcaggaaagcttcacaaccacaactgcatgtcctatggcccgggtgatttagagatggcccataagccggatgaatttgtcccctgtgaagatatcctacggtgccaggaggtgctcaccagactggcccgctccatcctcttttagaaattttacggctgaaatggcattatgacaatcttcacaggcaaatgacaaaagtgtggtaacaaaggcagaatgtggcgctgacctatcacaatttttcagcattataaaatacttaatatgtcctgtgtaaggctgtcaaattgcagcaaatggcaacgttaaaagcgggccccggataccggttgcccgcttttaatatcttccatcataaactaaaattcactaaaagaaaacgcccgtcgctccaattacgacaggcgttttcaaaagagagaatcaggcatcgcagcgctcctctaattatgtactgttttatattaaatcactctaattcaacaccttttagatataattgctgcagaataaaatcatttattcgattatcaatctccgttttatcatctaatccattacagatctcataaaacgcacctacgctaatctcacaaacaacttttttatttttttgctcccgctcaaactggaatattccattatcataaaatattgtgtaatcttcgttgctttccaggtctcttaaacaatgcctaatacttctgtttctataaatgccaggaaataaatgccaagttctgcccatgctatgtttcacctccatagtattattatatgccaaggattaacgaaaaatagcacatatcgaccaacaaatttcgataaattttttataaaagatgagctgcctgtacccagcctgagcctccatgcggcacagaaagagccataatcttcctaatttacatcttatcaatccctgatatgagcctatccaggtttttcatatcaattttatcaacttctctaagctcgtagccactgtgaaatattttctgagcttccaccgaaatacacggaataatccgatcttgaaacaaggcctttgtaaaccattctgccttgaaatcataccagtcatcatttaatccggcctgttttgcacttccgtcttcacttatggccaatggatgaatatctatataccctaaatccggatgatacaattcaatgcgtaccggactccaatcagtcacaactttatatcctttttctttcaaaacctctaataagacctccgtaaatattccatcaaaatccacatcaatgtctctgtgttccctgttttgccttccaagtaaaatatctacgccccagccaccgtctatccaatattttatctttaagctgtccagtaagttcaacacttccatcagattttctttcgtagtaatttctttattgtgcatagattctcctcatgaccattcccatattccttttcattttatcataaaaatcaccggctatcaattttcaagttttccatgtacagagatatggcaaataaacagcgcttggccctctccgcttcaaggcttaaggtttatccacggtgattccgcgacggaaagctgtccggcccatacgatgccggtgaaatatactcaagaaggctcctcggacacaccatacggaatgcttatgaacgctgtatccataagttaattcataatctgcgggaaactgtttgtacaatttcattgtgtcactaggggatcatactcctatcactggttgtaaaaaatccgttattttttttaatattttatttcgggggaattcttttattttcgctgttccagtcacatccggtttttcggcgaaacgaatgaattaagaaaatcttcataatctattcaaacaatatacaaacttttctagagccggtgtgctatactaatgacataagaaatgcacaatgtatcaattatcctttcaccctttttgaaatccgaaaatcctaagaaaaatccccctgtgtcatgtggcacagggatttttctattctgccaggaaaagcaagagaggcatttccggaatttccgaaaatcctctctcctgtcttcacacattttttctgtaaaaattaatattccatatcttttaatatgtcacagaaatcaaaggtagcaaaataatccttaggagtctcggccctgcggatcatctggacagacccgtcttccttcagaagaagttccgctgactttaattttccgttataattatagcccatagcataaccgtgagcgcctgtatcgtgaatgaaaagcagatcgcctttggatatctccggcagcattctgtctatggcaaacttgtcattattttcacaaagagatcccaccacatcgtatttgcggccgcacacatctccctcttttcccatgacagtgatatgatggtaagccccatacatggccggcctcattaagttcaccgcacaggcatccacgccgatgtattccttgtgggtatgtttttcatggatagcctttgtgaccagtccgccgtaaggtcccagcatgaagcgtccaagctccgtataaatggccacatctcccatgccctccggaaccaggatttcttcatagacttccctgactccctctccgatggccttaatgtcgtttgcatcctgccccggacgataaggaattccgatccctcctgacagattgataaaggagatatgggctcctgtatccttttgaagctttacggcaagttcaaaaagcacctttgcaagaagaggataatattcattggtcaccgtgttgctggctaaaaatgcatggattccaaaatgcttggccccattgctttttaatatgcggaatgcctcaaacatctgctctgttgtcatcccatatttggaatctcccggattatccatgatatcgttgctgatcttaaatatgccgcctggattataacggcagctaatggtctccggaatatgtccgatggcttttttaaggaactcaatatgagtgatatcatctaagttgatgatccctccgattttatccgcatactggaattcctcaacaggggtgttgttggaagaaaacataatatcagagccggaaaagcccaggcaatcggacatcataagctctgtcatggatgagcaatccgctccgcacccataatcctttaaaatatttaagataaacggatttggtgtggcctttactgcaaaatactcccggtaccctttattccaggaaaacgcgtcctttagcttctgggcattctccctgatccctttttcatcgtataaatgaaaaggcgtaggatattctttcacaatttcctctaacttctctttcgtaacaaatggtctcttctccatagctttctctcctctcgtagcttactatatagaatcatgagtctgcagctcagacccttacgccggagcaaggctgctgaaacagcctcactgcattggcatatcgtgcacatcctggcggaacattgtttgatcctcagaacataatttcctgtaaaccaaaaagaatctgtctccggcacatctgctggtaagcttcattgtaccggggatagactcctttgtctacactttttttgtataaatattcatagcagggcagatctgttaatctacggtaacgacccgcatgatatttgtatgagctgccggttcgttctttctcaccggactcaccacgcctgcagtgacaactaccgtatcattttctttaacgatcccctttgcttttaacagctccagggaggaataaattaaaacgtcagtggattccgcgcgttttgcatgaaatggctttacgccccagtatagctgcatctggcgaagggcggaagagcttggggataaaccgatgatctggctttccggtctccatttggacagcagccttgcagtaaatccggtgatacttggtgccacgatcacattcgctcccaggtcatgggctgtggaaacggaagaataacatactgcattggatacattgtggatattgacggcagaaaccttacgctctctgtatgcattgtaatccagatgcttttctgtttcctccacaatggaagccatcatggaaagagcctcaatcggatatttgcccatggcggtctcaccggaaagcatcactgcatccgtcccgtcataaacagcatttgccacgtccgtcacctcggctctggttgggcggggattgcggatcatggaatccagcatctgggtggctgtaataacaggcttgcaggcttcgttgcacttctgtatgatccgtttctggataaacggaacctcctgtgccgggatctcaactcccatatcgccgcgggcaaccatgattccgtcgctggcttcgatgatatcatcaaggttttcaatgccttctgcattttcgatcttggcgataacggaaatattggaaccatgatcctccaggattttctttatttcataaatagcgtctgccgtgcggacaaaggaagctgcaatgaaatcaaagccctgctcaatgccgaactttatatccattttatccttatccgtaagtgcaggaagctttacctttacattgggcacattgacgccctttctctctcccagctcgcctccgttgatgatcttacagataatttcctttccctttaccttaaggacttccagttcgatcaggccatcgtcaatgaggatacggtttccggaggacacgtcttcattcaggccgtcataattgatatgtccttttgtttcatcaccaatgatttcttctgttgtcaggacataggtatctccctcttttaaatttacctttctgccatcctttaaaagtccggtacggatctcaggcccttttgtatcaagaagtgcagcaatcggaatgtccagttcctcgcggatgctcttcagtgcatccaggcgcatcttctgctcttcataatcgccgtgtgagaagttgaatctggcaacatccatgccatgctcggcaagtgccttcatcagtgcgcgatcattggtattgggtcccatagtgcatataatcttggttctcttcatcattatcctccgtgctagttggtcgtatcaccggttgtggggttggactgtgttacatgtttatgtgtatataaatgctcggaacagtattcataactgccttcacattttgaacaataacggaattccaggttcggggagtccttttcggtccgcccgcacacggcgcaccgatggtgcgtccagccctggggctttatcttcatctgcttatgaaaattctgctttcttttgatctcctttggattgaacctgcttaaattccgggtcaaaaggaaaaagaggataaagttcaataacgacataaatatagtgactctggtggcaatgttgccggtaataaagccatacaggaagtaaattccgttaaagatggccagccatttggcttttatgggaatcacgaaaaacaaaaggaattccagatccggaaacgtggcggcaaaagcaaaaaacagggaataattaagaaattccgttgttaagtacaccgtctttcccatgaaaatatacacgatcagcgccgccgccacatgaccgatgactcccatgaagaagtaaacgttaaaacggaatgctccccagatcctctctaagttcactcccagcatgtagtataaatacatgctgatcaggctcatgaaaatgccgcctcccggcgggtaaatcatgaaagtagcaatcctccacacctgaccgcccagtatctttcctgcgtcaagtgataagtaattccagtaaaatcccggtgcgagcatctccatcaacaatcccacaccgtacatgccaatgatatagtacatcagattcggaattgcatactttctgaatctgcgttcaagattataaaaaaacttcattctttcatccttttcctatcttctgcccatgctctccgggcacaaaggaacaccctaagggtgtttcctgtttcctgtttttacatgcaactagaacagatcctttttggaaaaaatccacgcaacgatcagcgtcagggccagggtcaggcctaaaacaatggcaaagccgtaaggactgttcgcaaaggggattcccctggaattgacgttcattccataaaagcttgccaccatggttggtatggacatgacaatggtaatggttgccagaaacttcattacaatatttaagttgtttgatataacggaagcaaaagcgtccattgttccgcttaaaattccgctgtagatatttgccatctcaatggcctgcttgttctcaatgatgacgtcttccaaaagctccgtatcctccggatactttttgattttttcatttctcatgagcttttcaagcaccatctcattggaacgcagggatgtggtaaagtacacaaggctcttttccagctccaaaagctcaataagctcccggttcttggtggatttgtgaagcttctcttcgaccactccgcttttcttatcaatgattcttagatattgcaggtacaaggatgcattcttatacaggatctgcagaataaacctggttttcatatacgtatgaaaatccctcaccctgccgtccataaatgcattgagaacagtagtgtcttccagacagaccgtaacaatggcttcttccgtggttatgatccccattggtatggttacataccagtccttgccgccacgctcctctatggaaggaacgtcaaccaggatgagcgtgtaatggtcctctgtctggatacgggaacgctcttcctcatcaaggggcgctcttaagtcatcaggatcgattttacaggtgttggcgatttccaggatctccgtggcagtagggtctgtaagggcaatccaggaacccggagaaagctcatccttttgctgaatcaggccgtcttctgttttataaatctgaatcatagcttttctctctttcactgaaaaatcttattggaaacgttggcagactttgacttatacattataatttcccaggccatttttgtcaaacgaaatgaaaccccttttcgttaacttaaacaaattttactagttttaacatatttttagcacgttattgcaattgtattatttcttattttatgttaaactgatgttcggtgagccagaaacttacttctacacaaaaggaggcaggggttacccccgcgcatatgactacataccaaacattaggaatcgatattggttccactaccgttaagatagcaatattaaatgaaaaacatgaaatcttgttcgctgattatgagcggcattatgcaaacatacaggaaacgctggcaggccttttaaaaaaggcttatgataagcttggtcccctggacttatgtcctgccattacagggtccggcggcttaacgctgtccaggcatttaaaggttccctttgtccaggaggtggtatctgttgctacctctcttaaggattatgccccgcagaccgacgtggcaatcgaacttgggggagaagatgcaaaaattatttacttcaccggcggcattgaccagcgaatgaacggaatctgcgccggcggcaccggatcctttatcgatcagatggcggcgcttctgcagaccgacgcctccggcttaaatgaatatgcggccaattacaaggccatctatcccattgcagcccgctgcggagtatttgcaaagacagacatacagccacttattaatgaaggggccaccagggaagatcttgcggcatccatttttcaggcagtggtaaatcagaccatcagcggcctggcatgcggaaagcccatcagaggccatgtggccttcctgggaggcccccttcattttcttcctgaacttcagaaggcctttgtccgcaccctccatttatccggagatgagatcatcgctccggagcattcccacttatttgctgccaccggcgcagccatgaatgcagcggaggcccagggagggaatgtatccctggaggatttaatcaaccgcttatcctccggcattcggatggaatttgaagtaaagcgcatggaccccttatttgcggatcaggcggattttgacgaattcattaaccgtcacaacagccactgcgtaaaaacaagcgatctctcttcctaccatggaaaatgctttttaggaatcgatgccggctccaccaccacaaaggcggcccttgtaggggaagacggcaccctgttatataaattttacagcagcaacaacggaagcccacttgcaacggcaatccgggcaataggcgaaattaaagagcagatgccaaaggacagccagatcgtatggtcctgttccaccggctacggagaagctctcttaaaatcagccttcctccttgacgagggggaggtggagaccatctcccactattatgctgcagccttttttgaaccagaggtagattgcatcctggatatcggcggccaggacatgaaatgcatccgcattaaaaacggcaccgtagacagcgttcagctgaatgaggcctgttcctcaggctgcggctcctttattgagacctttgccaactccttaaactaccaggtagaggattttgcacaggaagctttatttgccaaaaaccccaccgacttaggaaccagatgcacagtgttcatgaattccaacgtgaagcaggcccagaaggaaggggcccaggtatccgatatttccgcagggcttgcttattcagttattaaaaatgccctgtttaaagtaattaaaatcacaaatgcttctgatcttggccggcatgtggtagtccagggcggtactttctataacaatgccgtcttaagaagctttgaaaagatctcaggctgcgaagccatccgcccggacattgcaggcattatgggcgctttcggcgctgctcttatcgcaagggaacgctacgaggaatccaaaacaacctccatgctgagcctcgataagattttaggacttcactatgaaacctccatggcccgctgcaagggctgcaccaacaactgtgtgctcactgttaaccgttttgacggaggccgtcaattcattacaggtaaccgctgtgaacgaggccttggcaaggaaaaggcaaagagggaaataccaaacctctttgattataaaaaccgccgcatgtttgattacgagcccttaagccctgatcttgcggagcggggaaccatcggcattcccagagtcttaaacatgtatgaaaactaccccttctgggccgttttctttaaggaactgaaattccggaccgtgctctcacctcagtctaccagaaagatctatgagctgggcattgaatccataccaagcgaatcagaatgctatccggcaaagattgcccacggccacattgaatggctgatgaagcagggaattaaaaccatattttatccctgtattccctatgaacggaatgagactcctgaggcaggaaaccattttaactgccccattgtcacctcttacgcagagaacatcaagaacaacgtggaaggtattaagacggaaaatatccgctttttaaatccgttcatggcttttaccaacgaagaagtgctcaccggacgcctgacagaaatatttgcaaaggaatttcagatccctgcatctgaggttgctgctgccgtttcaaagggctgggcagagcttatggcttccagggccgatatggagaaaaagggcgaggaaactttaaaatggctggaggacaacgaccgccatggaatcgtgctggcaggccgcccctaccacgtggatccggaaatcaaccacggcattccggagcttattacctcctatggatttgcagtactcacagaggattccgtttcccatctggctgaaatcgaacgccctctggtggttactgaccagtggatgtaccacacaaggctttaccgggctgctgctctcgtaaaaaaggagagccgtctggacttgatccagctgaattcctttggctgcggtctggatgcggttaccacggaccaggttaatgatatcctaaccggctccggcaagatctatacggttttaaagatcgatgaagtcaataacctgggagccgccaggatccggatccgctccttaattgcggcactgcgggtgcgtgacaaacgccattacgagcagaaggtagtttccagcgcttatcacaggattatgtttaccaaagagatgaaaaaagattacaccatcctgtgccctcagatgtcaccgattcattttgacttaattgaacctgctatccgttccttcggctaccgggtggaggtccttcaaaacgacaaccgctctgccattgataccggattaaaatacgtaaataacgatgcctgctacccctccctcattgtggtgggccagatcatggatgcccttttatccggaaaatacgacttggaccgcactgctgtatttatgagccagaccggaggcggctgccgggcttccaattacatcggatttataaggcgtgccctggaaaagtccggcatgggccatatcccggtcatctccgtcaatgcaaacaacatggagactaaccctggattcaccatcaccctgcccatgctgacaaaggccatgcaggcagtggtatacggcgatgtctttatgagagttttatatgccacccgcccctatgagaaggtgcccggctcagccaattcccttcacgagaaatggaaagagcggtgtattcagtctctgtccaggaaatccccggacatgatgaccttctcccgcaacataaaggggatcatcagggattttgacaatctgccgagaaatcccggccagaagcctaaggtaggaatcgtaggagaaatccttgttaagttttctcctctggccaacaatcacattgtagagcttctggaatcagaaggtgcggaagccgttatgccggacctgatggacttccttttatactgcttctacaacagtaactttaaggcccagaatttaggcggcaagaaatccaccgcagccttatccaatatgggaatttccctgttggaatttttccgcaggacggcaaagaaggagctgctaaagagcaaacacttcactgccccggcccatatcggaaatctggcagacatggcaaaggaatttgtatccattggaaatcagaccggcgaaggatggtttttgaccggagagatgctggagctgattcacagcggcaccaacaatatcgtgtgcacccagccctttggctgcctccccaaccacatcgttggaaagggcgttatcaaggagctgcggaaagcttatcctgactccaatattattgccgtggattacgatcccggcgcaagcgaggtaaaccagttaaaccgcatcaagctgatgctctccactgctcagaaaaatatgctcagaggagaaaaaccggcggaaacggtataaaaaagataccgggaagagataaaagatcttcccggtatcttttttattgcgtgtattttatgagtttctcatttcctatgagccatcttcctgtattcccccggcagcatacccgtactcttacagaacagttccgcaagcctgctggcattggaatagcctactacctgggcaatctgaccgataggcagatccgtgtttgccagaagattttctgcctggctcatgcggcgctgctgaatatattgggtgatggtgcagccgtgatattccttaaatatggtttgaagtctccttgccccgatataagagattttcacgatctgatccagggaaatgtcctgcaggcaatggtcgtttaaatatagcgtgatattgtccaaatccttaatatcctgggaggacagcctctttttaacttcctgtttttgagcctgttttttactccattccacaatgagggaaacagctcccgcaaccttcccctgataatagagctttgctgccagtccgcaaccgcgataatcccggaccgtcttcaacagccggtccatctccggaaaatctactgtctgccccactgccgcaaatgcgtttaatggattggtatattctcccgggtaccggtcttttaaaaaccctcataataccttggcataatttcaattccaatggattttaccgggattttcttatgtatcagaaccttatatatgccataaccgccgataaaactcttaacagttccggcttccagcctccggtaaggagagagctcttcaccggagatggagtcatactgcataatacccaaacattcaggccagcaaaaatccattacagtatcctcatggaaataaaaatcatgaattttgacggaaaacaaatcctgctctccatatagccagaaggttcccctgccaatggtatctgacagcttccatgttgagccgacttcgcaataagtatgattgtccggatccggcaaaaaaccatgttccgcaaattgttttttataatattcctgaatcgtattcatcatcgttcccccatattcccaatacctcaaaagcgcaaacctttaccttgaaagtgaaaatctgcccaaaacctattgtaagaaatttgccatacgtgtattgttataaagcagttagcttcgcctaaccatcatgatagcataacggaatggctgcgtcaagaatgtggcgctccggcctgtttgcgaagttgctgaggaccagataaaaagctgtacttcatagaataaaacggcttaaaaaggaggaaggatttctatgcaaaataagaaaagtcccattaagctattgcttcaatgggccggacgggaaaagtattggatgtatttggccattgcactgtcatttatcagcggccttttcaccatgattccctactatggtatttatcaattaatggaggccgtgtacagccgcacctgtaccgctgaatttgtgcggcataacgtagtgctcattgcggttgcagtactgattcgattcctgttgttcggatcttccggcgtggcttcccataaaggagcttaccgggcactgttcaaggttcggtgcatggttgcaggccacatggcaaaggtgccgctgggatcgctgaatgagcgcagtaccggagaaattaagaccgtgttaaatgaggatattgaaaagctggagctgtttcttgcccataacgtgcctgaactgacctgctatttgaccggtcctgttgttattttcctctatttaatgacagtaaatgtacctctggctttgatttccttgattccgctggtcctggccgctgttgtgatgggcttcatgtttgtgaaagcctccggaatgatggacagggcaaaccgttctgtggcaaacttaaactcagtcatggtggaatacatcagcggcatgaagctcattaaagcttacaacatgggaagcaagtctttccggaaattttcttcggctgtcaaagaggaaaatgacgtctggaatttaatgtcaaggaaaatggggccattttacgcttcatttatcgttgtgatcgagtgcggaatggttctgatggtgcccttgggcggcttattctatatgaaaggctccattaccgccagcgtgttcctgttatttgcatttgtcggctccatgtacttaacggagatccgccccttacaggaaatttccagcagctttgcccaggtgcttaccggtgttatgaaaacagaggaaattttaagctgccctacctttgagggtggcggccccttcccggactgccatgatattgagcttcgtaatatccggttttcttatgacggaaaaaccaatgtgctggaaaattgcaatttaaaaataaaggaaggcgaggcaatggctctgatgggacgttccggcgccggcaaaagcaccgttgctgagctgattccccggttttatgatgtgcaggaaggcgaggtgttaatcggcggaaagaatgtcagggaaattgactatgaaacactcctgcaaaatgtttccattgtctttcagaaaacatttctcacccgtgacagcgttcttgaaaatatccgcatgggcggccatgggagtctggaacaggtgcgggccgctgcagagaaagctcagattgacgacttcattatgtctctgccggatggttacgatacaaaggtaggcagcttcggatcacgcttctccggcggcgaaaaacagcgcatcgccattgcaagagctatcctaaaaaacgctcccatcctgattctggacgaagccacaagtgcggccgatccggaaaaccaggtggagattgacaaggcaatcaaaaacctgtgcaaagggaaaaccgtcattatggtggcgcaccggctgagcgcactgaacatgtgtaaccgggtggctgtggtggaaaatcaaaccattacatcagtgggcacccatgaacaggtcaggaaagaaaataagtattacaatcaggcctgggcagactatgagacagcccgcagcctgacctatcaactggaaggaggcggtaaggcatgaaggaaaatccaatgaaaaagggaaggaagttttatatgggcatggtcttgaccgttgttgagggcatgctgtccggatgcaatttctttgtcctttatgaagttatgaaaatgctttggaaaggaaatgccgggcttcccgctgttatgaaactggcgctatttcttggaatcatttttgtactgcggatagtcatttacagcatgggttataccaacaatcagatcggcgggccgccgtcagcaaaaaggttcgtctcttccttggcgacaagatcaagaaaattcccttatcacggttcactcagggacagatgggtcaatacatcaatattgccaccagcgatgtcaatagctatgaaaagattttgacccataccatggggaaccttgtgaaaaatataacgttctctgttatgctgattctttttgtgtggcatatctggcttccgggcggtatcattctggtgtgtattgaattactgctggttccattcctttggaaagctttccgtattgtcaaaaagtatggtacggagaaaaatgccgtatgcgcggaaaatgtaagctgcattgttgagtatgttaccggcatccaaaccttcagggcttatggaatgggaggttcaaaaaataagacccttacctcttccatgagagaattttgtgatatcagctatgcctatgaaaaacatggaattcccgtcaatgcagtccagtgcatttgcatttgggcaggtctgccgattatgatcctggctgcctctgtgccaatgctgaacggaactcttgaccccacatcttatttgttgatcagtattctccccatgcttcttgcaaagctggcggataccatttcaagagatttgatgagctataaaaacctgatgatttctaaaaataaagtgacgtgcatcatgaaagaaaaagaggaaaccggcagtatggaggcgtttacatcaaaagcctttgacattgcattccggaatgttgaattttcttatgtgccgggagagccggtactaaaaggaatcagctttactgtgcctgatcagaagctgactgcaatcgtaggggattccggctccggcaaatctactattttaaatctgatttcaaaatactatgaggcacaggccggaacaatttccattggagacctgccgatccggaatgctgccccagagaggattttagaacagatatccatggtcgaccaggatgtgtttctgtttgacgataccattcgcgacaacatccgccatgcacggccagatgccgttgattcagaaatcgaagcagcctgtaaacaggccaactgcgacggttttatccgaaagatggaaaaaggctatgatactcctgccggagaaaacggcaatctgctttcaggcggtgagcggcagcgtttgtccattgcccgggccattttaaaaaacagccccatcctgcttttggatgaggcaacggcctcccttgatattgaaaatgagctggcggtaaaacaggccatttccaatctgctgaaagcaaaaaagaccgttgtgatgattgcccacacgctttccattgtgaaacacgcggatcagattttggtagtggctgatggcaggattgctgaagcaggcactcatgaagagttgctgaagaaaaacggaaagtatgctgccatgtggaatgcggagcagcagctttccgcataggcaaatatctttcagatgaaaacctatttaaaacagaagccggggagataaccattccctccccggcttctgtttctgtttctatatggcaagaatggaatccagacattggttttccactgcattcttcagctcatagctgtaattacgcagatcagccttcagataatctcccaattcttccagcccgccatatccggactgtaccagttcatcaaccaatccctccatatcctgttccaatgaggctgtggtatcccggtttacataaccgatgagccgttccagctccccatgggtatatccctgggcccggaccctttttcctgctatgcggcagcccagaatgttccgcagcacaatgcccgcaagattaatgaccagatccccgtgatccggggaataggccctcagcacatggagaacatattcatccggtaattttccaaggaaaacctgttccagactgacatatttcacaaaagcgcttatggcatcaattcccatcaaagtatacactggatacaaaaccggataatccagcgtaagaatatgattctgaggctgaaaacgcggatcataatacataaaaaaagaggggattcctttgacaaatgtatcgtgataacaccggttttcataatacttaaaatccggaattatcttgttatacagaatctgggtttccttcaccttcttcagcaccgtctcatatcccaggctatagaccttttttgccactgccttctcatccatagaaagaagctcccgtcttttttctgcatctgcttcatattcatggatacagtacaaaaccgcttccatgagctgccttgctttttcataagtaatggaggtactctcttttcccgtatatttatctgctaattccgccacgattggaattagctcttccgtctcaaaactcatcgtcgtcttcatacagatctaatccagaacggacgcgtctggcaaaagcctccaatccagtgtcctccagatgatcaagagagccctggcacggtccgtcaaactggtctttcataaatttgatcagttcatcatcggtaatttcatccaatgattcatttttatacaggtaaaacatatcctgaagccttcccagggaatccacgtaattatcctgataaatatacggggaatcacaaaacgcaaaaatcagtttcggaaggatactctccccgaattccacccgctcctgctcctttaaagcatttttcctctccccgataagcagagatgcctcctcatccgttaaaacaaggccaaacctttttgtataatcattggccgcttttaccctggcaatctgaaaaccgtcgtttgcagtctgtagccacttcccatcttccataaaaaaccctcctatcttctgataaatacaaagtctactccaggcggagcggaattacaagacttgaaaaaaattcatttttgtggtatgattattgcacaagagataagggtttcctttctctttttcatttttttctgccttctttttcaacataccttatgttcctgtttctgatttccaatccaaaaacggaagccttccataatatgaatacaagagaaaagaatctttattaaatgctggcagaaaaagaaaacgactatatcatccttttatcagatgaaacagtcgttcagttaaataatattcatataaaattgaattacaggcttaatcggaacctaccttatgccctgatgataacaaatgctccggcaggtcaagcctgcatctgacagattttattcttccaatacaattaaacgcttttcttcacctgactgatatgctgcgtacattacttgagcggtataatatgccacagaaaaatccgataaaggttttcttccatatagcacacactccataaaatcctgcagttcacccaagtaccctcttgtcagctcttcattcaatccaacattctgccagccctgtttatttcctaacttttccgaaaaatacacatcttccaaaccactatcatcttcatgatatacttctaaatcattgcactgactgatattacagcgatgcacagaactgttagtataaatttccagggagtttttcattccgcccaccaaaatatccgtagatactacatgggcctttgttccatctgtaaaagtaatagtcaagtttgcaatatcctctacatccaccggatccgcatcaatatatctacgttcttccttctttagcgccttagtgcatacacctacatcagccagcacggaccggatgccaaactgctcgcctctggcttttgcttcctcctgttttaaaaacagaacacccgaaatcggatggcatccctgcctgatcaaagcaccgcctccggtatacttccagttggcagcatgaaaggcatgagagccattgtggctctcctcagcctgcatgaataagattttatctttgcgggaacgtatgatctccagactcttttgcaccgcagaagcatatacccagttctccgcatacataaaatagcggtcactgttttccacaacctcccgtatccgttcaatccgttcccttaccttttcgtacatcttggcttttggaacagaaagacctacataatctacctggtccccttcgtcaaaatagccggttaacggcttttcacagataacatgctttcctgcctttaaagaattaataaccatttcttcatgtaaaaatggaggtgtgcagatatcaataacatcaatctcttcatcttttaacatgtctttataatcttcatacacagccgcaatgttatatcgcttaacaaactgctccgtctggctggccggaccattgctggcaaccgccttaatcaccacctgcattccatagatcttttcataaccgttcatatgcaatcctgaagcaaatccgcaaccaatcattcccactactacttttttcaaactcattccgtcctctcatgattatatttgcgtttttttaatttattaaacaccccaaactgcgacaatattaagcaggtaatcacgataacaaaaaataagcaaataggtctggttacataaggagcaaacctccattacttaacttaagccctcgtcttaaattggaatcagccatatttccaagcaccagccccagtaagaacggagctgccgggaacttggcataactaagtaaaaagccaataattccaaatataaacataaccttaatatcaaagaaatttccacggattacataggagccgaggacacagaatacaaaaatggccggcatcagtgtctcttttttcaatgacaaaatcttaacagttatctttgataccagcaatgccaaaaagaacatcgcgattgaggaaacaagcaaataaatggcgatctgatataaaaactccggtgtttcagacattagaagcggacccggacggtacccgtgcagccagaatgctgcaagcagaaccgcagccgaagtacttccaggtactgccagagaaagtaccggtataaccgcacctcctacgcaggcattgttacctgactccgctgatataacgccttcataggcaccctttccaaacttttcaggttccttgctcaaagtcctggttgcccaataagaaagccatccgccgatatcttccccaactcccggaacaattcctacaaatactccaattaaagaagaccttacgatagctgcaatattctttttaatcaacaatagaccttccttgatgtccagtttcgtcatctccagaatacttccctcatccttttggaaggaacggagaatttccggaaaaccaaacaatgctatcatcataggaatcagctgtagtccagccttcagattcagtatcccaaaagaaaaacgcggataagctcctaccgtatccagaccgacttgagccaccagcagtcccataaaaccagccatccagcctttcagcggatccccgttggaagccagattgccacagatcacaataccaaaaagtgccagaagaaaaaactcgtaggtctggaacttcaatccgacgccgctaagaaatggggtcaaggtcaaaacacagataacacttaaaatcgttcccaatgcagatgctgctgtcgctgtaaaaatagccagacctgcttttccctgcttacttaacggatgtccgtccattgcagttgccgcagaggccggagttcccggaatattaagtaatattgcggattgacagccgcctgagatagatcctacataaactcctattaaggaaacaatcgccgtctcctttgataagctaaacgtcagaccagtaagcagcgctactgccatggtagaggtcagtcctggaagcataccaacgattaagccaaaaaaaacagatacaattaatgtaagaaaattaactggactcataacaatctgcaatgcctgtaataaataatttactgccatcctcttctccctcctctatggtaaaagtacgccaaatgccatctgaaatgtaacataaactgccccaacaattataacagcaatcaatacaatctttataagactgcctactttcatatacatcatcatagctacaataaagatcagtgtggatatgacaaaacccagcatgggaagtaatgcaaaaacataaattcccataatacaaagcccgatcaaagcctttttaacggtttcagaacggacaactcttacagcactttttttcacttgagccatggtaacagaaataccaatacctttcaggcttctgctcataagaatcccagcacagatgaatagtcccgcacccagaattaaggggaaaaatgctggcgaataatacattttctcgcctgcatccagatacatacgaatactgtctatgatgacataaatcgataatagtcctgtcaccaccgcactaaaaaaatcaatatattttttatctcccatctatttaccctatccttccgtaaaaagggccggtgaatcatgattactttcaccggctcagtccagccgtctgatgcttatggtcttggaatacctaccgtatctggagaaattttagcactgccgatgtcatataaagtccagcatacaatggacgccagtttatcaagatattcagaagtatcaaccacatcatatccaaatacgatcatccccttatcatctgccagcttcttaaatgattcagactcaacagcattcttataagcactatccagtgcttcgatcacatcttctggtgtttcctctggtaccatgatgccaaaagactctccaagcggaagaatttcctccatttccggtgccacagacttaatggacggaatggtgatttttccggaaggaccatcaatcaccagatcctcatcgctcaaacaagccaggccaatcaggtctccggaacggatcatatcaatcatttccatagaaagctgtgccgtaaaatctacttctccagacaatgcagcgataattgccgggttaccgccttcataaggtatgtgagtgaactcagcaccgactccctgtgcaaatacggatgctccgatatgtccgccagttcccacgccagcgctgctggcagtgattttacctgggttttccttcatagccgcaatgagatcttcaatggtcttataaggagaatcttttttaacggcaattacgttgggagaaaatgcagcatcccatactacccatttcttatagcttgtgtccaccagtcccataacctgagaattggtaaatgccatcataccatgacccaagaccttatatccatccttaggcgaatcatagacatcctgcattccaaccgagccgctggcgccaggcatgttggttactgtcatacgtttaccaaggtcgccgctcatttcctccaccagagcacgaacagtcagatcggtaccgccacctggattccacgggacaataaccgtgatatcttttgtcggatagtcacttttggatttggcttgttcggtttcaccggtctcctggtcagccgctgttgactggttctcggccagtgccgcagttgttgcttttcccccgccgctgcaaccggtaagaccagctgcaaaagtcagtgccactcccagtaaaatcaaagttcttttgttctttctcatcatacttcctcctgatttatataatatggttttatttgttaagtaaacgtttacatgttaggtaaacgtttacttaatgccgatactatacgggagtttttctcccgttaatactaattcagctgacttacagttcctccttcatacaaatccgattccacaatttgtctgatatattctcctggcatagtctttccctccagttgatcaagtaggattcttgcagccacctcacccatcctggttccagcctgggcaatccttgtaatctcttccatccgcgcccatgccggatttcctaccatggcaacagaaatttcttccggtatcttcaccttctgctttcgaagataagtaattccatcttccgcaagtaaatactgaccatatataacagcagtgacctggctgttttccaatagctctttggtcagtctcattccggttccttctttcagatcgcccttctttaccaatgtctggtcaaaggaaactccagcctgtctcagcgcttctttatatccgctcacccgttcgtaaacgtttgtaatggccgtatcccaataaatcatgccaatatgtcggtgtcccttttgtatcaaatgctccgtaatccggaaaccgacttcaaagttatcgctgcttacataatgatattgctccgtttttgccaacggacgctctattgctacaaaaggaaggttattatccatcaagatggacatattttttcccccttccacagtaggaatcaccagatatccatctgcccggattgtcagcatacgttctaaaacttctttttcatgctttggatcatcaaaggtattgcaggttgacaatacataaccatactgattcgcaattttctctattgcaataaacatactcataaaaaatggattctcatactggggtgtcagtaccgccaggattcccctttgctttcctttcaagctgctggccagcccgctcttaacataattcaaatccgccgccgcgtttaagacccgttctctcagttcatcactgatgtaccggtctttcgaatcattgagcacatatgaaacggtggcaatggaggttcccgccatttctgcaacatcccgtatagtaacataacgggaattagtcttttttctattcatgcttctcttctttcactatgtagatatctgcttattattataagtaaacgtttacttatcgaataaaatccaaagcaattagattgtaaattaaattgtattatttgtcaatatattatttgtatttttttattatctatatggttttaacaaatttcctttttttattttgtataaaattctatacttgtatttattttatattttcatctataacttttgtttatatttccctatatttcccttgtttccccctcaatctaaacttataatagaaatcaaagtaaaaaacaggaggaattttctaatgcaaaaaagtgatggcatgaactatgcccctcaaggaaaaacaaaacccgttgttaaaccaggtgaatttatgtttgcggttaccgccttaaaacatggacatatctatggaatgaccaacggtcttgtagaggctggagcgactctgaaatatgtgtatgacgacgaccccaagctcttagaagattattgccgtacatatccccaggctattcgggcagagagcctggatcagatccttacggacccggacatccagttggtagccgctgctgcaattccctgcgaccgggcttctttaggttttaaggtaatggaggccggcaaggattattttaccgacaaatctccttttaccacactggagcagattgatttagccagaagcaaggtaaaatccacgggtcagaaatacatggtatatttcagcgaacgccttcatgtggaaagcgccgtatatgccggccaattaatcaaagacggggtcataggcgatatcctgcaggttatgggtatgggccctcaccgcttaaatgcaccgtcccgtccacaatggtttttccagaaggagaaatacggcggaattctctgcgacatcggcagtcatcagattgaacaatatctgtatttcagcggttccaccgatgcacaagtagtacgcagccaggtggctaaccataaccatccggaatatccggaatttgaggattttggcgaagtcatgttagtaggcagcaacggttccagcaactacttccgggtagactggtttacccctgacggactgggctcctggggcgacggaagactttttatactgggaaccaaagggtacattgaacttcgtaaatatatcaatgtgggagttgacaaccgttccgatcatgtattctacgttaccggagaaaaagaacattatgtaaatgtcagcgggaaagtaggctaccccttctttggcgaactgatcctggactgtataaaccggacagaaattgccatgacacaggaacatgcttttaaagccgcagaattgtgtattaaggctcagatggccgcagaaaaaataagataagaagtggtgggtggggaccctctcctgctccttcagtttttttcactttctggaaattagtagtatccagtattctttaatatccctcttctcttccgtcctctgctgttatcgcagcaaatgtggaaaccggaatagaaagtacaatttaagcatacaaaaataaattagcatatatgtaatttcaaacctaaaatggtggcagcagctggaacctcttccaaaatacggcaagattacggttttcttaacttgtccctggtttcttacgcattcttacgccttctttacatcccttgaccttggacttactccatggtttaaagtcattccatcagcagaaaagctgagaaagcaacaaaaaggggttcttatgaaaggagaacaaacatgagaaaacagaaacttaaatggctgattccctgcgctgcagcgctttttacaataggtgcatccatgacctcctttgcagctcagggctgggctcaggaaaacgacacctgggtatacttggactccaacggagatataacaaccgaatcctggcgcaagtccggtgacagctggttctatttaaatgaagacggcgaaatggctaccagcagcttaatcgaatccgatgacaattactattttgtaaattcatcaggagccatggttacaaatgaatggcgtgaagttccttccgaccaggatgaagaggatgaaccagatacttactggtactactttggcagcaacggaaaggcctataaggctcctacctccggcaaaaccacctttaaatccataaagaccgccaacggagaatctcataactattcctttgattcagaaggaagaatgttgtttggctgggttaatgatgaatccacacgccagaccggtgacgatgcatggaaggacggtatctattacttaggagattcctctgacggcgctcaggcaaacggctggaaatccatcgaagtagaagattcagaaaatgagaaagacaatttcaacggagcctactggttctatttcggcaccaacggcaagaagataaaggatacaacaaaaaccatcaacggtcagaaataccgcttcaatgaaaacggagccgctgaatcagaatggtatgaaattgcctctgcttccacttcaagttccgctaaccagtattataatctcccagaacagtgctggcttgcaaaaggctggttcaagaccgttcccggagaagatattgatgcagaagcttatgatgacggcacagaatactggttctacgcttccagcaacggacagcttacaaccagccagatcaagagcatcaatggcttaagctacgccttcaacgaaaagggcgaaatgcttcaggggctttataaactgacctttgaatcaggcaaaaccatcgagtcttacagcgagatcgaaacagaaagcgatttccctgctgcagacgacgcagcagaggtttactatttcggcacatctccaaaggaaggcgccatggcaaccggcaagactaccattgatattgacggcgagaaatacacctataacttccgcaaggccggaagcaataagggagccggctacaattccatcaccgatgacagcatctacgtacagggcagactgatcaaggctgacaaagatgaaaaatataaagtagtggaatacaatgacaaagagtacttagtcggtacaagcggaaagcttgctaagggcaagacaaacattcaggatggcgacggcaaatactacaagaccaacagcgacggaaccatcaaagaatcaggatacgaaaagataaaataaagtaaaaaacataagaaaagggaggcagcagcggatattccgcgctgcctcctttttatcctttatgaacctgcatacacctttgccccttcatagatttcttctgaatctacatggtcaatgaccttctctccctctgtcagcccttcttttataacagcctgggatgcagtcctgtattcgatctcaacgggatgcttctccgcccttccatttttgatcacaaatacatacttctgatcatccagttcaaagacagcacttgaagggatcaccagcttatcgtccccctgatacagggtaaagcggatgttggcgccatagccttcctttccttccaggtccggattctcatccatgtcgaccttcacatgcaccctgtattcatccattcccagggcagaggtccctttagcagcatagtcatagacctggcttatggtccctccgtacatttgatcctgatttctaagctgcagaatcaccgtcactttatctcccggagtaagataaggtgcaatgctggtaagcacgtcagactctgcctggacctttcccctcccgcttatggtagcggcagtttcccctgcctgtatgtaggacatatccttgacaggaagggaggtgactattccatccctgtccgcagctaccacacattttttcaaccggtcttccagctgttccatggtagtttcctgggatttgatctgggcctttaactgctcttccacactttcataaaaccttccgttaatggtggtttcgtcaattccccctgcctttaagctctctaaaaaccggcggctttcctcatagcggctcttcgcctgctcccatgccagagaagcgtactcataggaagcccggtccttttcccactcgattttagaaatactccctgcagaatacagggactgggatgcgtcaaaaacggtttttgccgcctggtaatccgcttcttttgccgatacctccgctcttatggaatccaaatattcctgaggcgatgacgtcatcacctgcccgatccggctctgctccagcttggccttatagcctgccagagcgctttcacaaagagacttttcatgcaataaatccttatcatcaacggtaaacaggatatctcctgccttcaccccgtcattttccctgaccataacctcttttacaggtcctgccacctctgaaaccaggcggtattcccctcctgccgtaatggttccttcctcagtataccggtcctctacggtttcataggaggccgctgcggtttccaccggggctccttttaagcttttcactgcagcccttcctatgatcagcacaaggacaactcctgcagccagaaagcatattttctttttcctgccatccaatcggatcttcataagcctactccctttcctttaatatatccgtgagctttatccttcttacaaaccgcgtctgggccagcaaagaagcccctgccattgcaaggcaggtgagaaacgctatcccataacaggatggccgtatagccagatcaatggtataggaatcggatatgaccagatgctccaaaaggtattttactccaatgcttccaaatattcctaaaacaattccaagaatgaagtaaaccacctgttcaaacaggaggatccttccgatctccctatccgttcctcccatgataataaacgttccaagctctgagatccgttccctgatattgatcatggaaatattataaatgaggattcctcctgccgccactgccataagggaaaacatctgaaccattgccatcatgctgcccataatgtcccggtagctgtcaatgatgcggctggtatccaccatccaggtcacccggctggtttttaaaagctcttcccggacctcgttaagccttcccttttccacctttaaaagaacggttcccgccattggaacagaaccaaaaaagcggtaaaagccttttgaagacatatagcagccgcctcccagactctcctgtatgacagcctttacgggaaccttcaccccttccgcagtcaggccgggaacagtcacttccattaggtccccttcctccaggtgaagcttttttgcgatcctgctgtttatgaggatcccatcctccggcggctcataaaaccggccgtagagatccatgatcctccacatgtcagactcagggttcaagccatagaccatggcaaactccgacagattttcatgctttaattccactgccttctggagaactgcctcgctttttctcactccccttatcccctcccctgccaattctcccctgataggagatacaaaacggtccagggaaatctgtatatcataggtctgcactttgctgaactgatcgaaatacatctgatccgctacccctttaaaggagaaaagcacagaagacatggaaaaagggaatgcaatggccaaaataatcagaaagcctcgaaaagggttcctcaccacagagcgaagtcccattttctccatggctccaagcctggaggataaaaagccgggaagtttcaaattccctgcagcagcaggagcctttgccctcatggcctgggccggagtgatctttaagattcccatgacccctaaataaaccgccaggagcccggtccccacggcaattcccatgccgctgatccttgtattcatgtagctgtgataaaccgtgtccggcaagttaaaaaagtccacatacataagaaacataaaccggccaaagggaaccgccagaatgcttccaaccaaagcgcctaaaacgccgacctcggccccctggtaaaggtaggccaaaatcaattcaccgtctctcatcccaaaggatttcatggtgcctatgaggctttgatccttgtctatcatcttttttaacaccacataaagcatgaacacggaaatggacataaacagaaagggaagcgccgttcccatggaatacagctcattgatttcgccctttaccatattatagctggcctggttttcccgggaggaaagggatatcaggccatacccggaaaggcggtccatgagctgatagcgcacatcttcataggtatatccttttgccagacggaatcccagctcattcatggaatcctttttcccggtcaattcctccatcctgcttttttccacgcaggcaatgtcatagatctccccatcgggtaccatggcacctcccggaggaatggcatatatgtattccgggccgtaacaggttcctgccaattcaaactttacgctctttccattgatcatgagggtgagaggcgtcccgttttcgtaaccatatattccggccatccggtttcccagataaatactgtcctttcctgtccccatcccttttaccatcagcttatttaaaggatcaataggatcgtaagacagcagatgcacggtcacgatctctgtctgggaaggggcaaacagccttgcatcaacagccatttttccagaagcctcttcgatccctggaatctcctttaaccgttctaagtccacctccgatattcctgaaacttcggcgaacacgtccgctatggcgctgctgtcataataacgctgtacctggtcccctaagtttcttaaggtgtccatcatggcaacatagacaaatatgccgatggcaatgatgaaaacggcccccagaaaggaacctggattctgtctggcacaccggaccacattcttgcggaagcttttcactaccagaccacctcctcaggctttaagggcgtttcattgacacggatcctttccaggcacccatccttaaaataaaacacccggtctgcgatccctgcaatgttctcattatgggtgatcagaaccaccgtcttttcatactgtctgttaaaatccgacagcagctttaaaatctggcttccagtgccgctgtccaaggcacccgtaggttcatcgcaaagaaggatatcaggattcttgcacaaggccctggcaatggccaccctttgctgctgtcctcccgacagcctgcttggaaaatgacctgctctgtccaaaagccccacctgttcaagcagtatctccgggtccagaggatctttggaaagctccgctgccagctgtacattctctaaagcagtcagtcctggcatcagattataaaactgaaagataaatccggcatgagcccggcgataagcggtaaggctctttaaatctccccaggagagtggtgtgccgtcataatagacggtcccgttggtaactgtttcaattcctcccaatatatttaaaagggtacttttcccggacccgcttggccccaggatcacaataaattccccccggagaatctcaaaagatacattccttaaggcctgcaccttgacttcacccgcatcataatccttgcagacttcttctgcccgtatcaaaacttccataagtccttccctcccttcttttcccccatcatacacccatgttattatcaatgcaattctccgtcaatatcatccggcgattatttttatcaacaattataattattttaaaatatacaaaaatttcatgaaaatcatacaaaaaaacaaagaggaaacgcccgcctcaaacctgcgcagcttcctctttgtctcttttcctcgtcctcaggcagatatccgaaccctgttccgacgttacttaacccttcagcccccagtataccttttctgccgtaacaggcagctccctgatcctcacccctaccgcattagccaccgcatccgcaatggcgggagaaggagtattgatcacgatctcgccgatggatttggcaccaaaaggccctgtaggttcatagctgctttcaaattccacccggatattccccacatcctgccttgtgggaagcttgtactgcataaaggaattctccagcatctgtcccttggaggaataagtgacctcctcatacatggccatgccaattccctgggcaatgccgccttcggtctggatcctggccagatttggattaatggtggtcccgcagtccactactgccacataatccagaagctctacctctccggtctccttatcaacttccacctcagccattcccaccataaaaggaggcggcgacacaggagaactgtggctggccccggcagagagcatatcctcattaaagcacatgaccttatttccaatatcctttaaggatatttccagctctccctcctgctggtacaccctctttccgtcaaagtccagggtatcctccgggcagccaaggtattctgctcccttttttataatttttccccgcatttcgtggctggcctttaccacggccattccggttaaatacatggtgctggaagcataggaaccggaatcatagggggaaacatccgtatctgttccatggaccacgatctcatctaaattacattccaggcaatccgccgctacctgggcgagggtggtgtcacagcctgttcccatgtcggaagcaccgatcataagggtataaaaaccgtcatcattgaggcgcagctccacagaagccacatcaacgccggaaatggcggatccctgcatggacatggcaacgccaacgccccgcacctttccatttcccatgtcaacccctgggtacttttcatcccagcggatcatgtccttggctctggccatacaccggtccagggcacagcttcttagagtttcaccataataggctggcatgatatccccttcccttaccatgttctgttcccttaattttacggaatccatgcccattttctttgccagctcattgaccgccgattccacagcaaagattccctgggttgcgccatatccccggtaagccccggaagacatgcggttggtgtaaaccacatcatatgcaaaccggaatgctttggcagtcccgtaaagaggtatggtcttatggccggacaagcctaccgtagttgggccgtgttccccaaaagctcctgtatttgacagggtatgcacatcaatggcctgaatgatccccgtcttatccgctcccaccctcacatggacttccatctcatgtcggggagacgcggcgatctgggactcataccggctatagatcatcttggccggcctgccggtcttcatggtcacaattgccggatacacctctgccaccactgtctgctttgctccgaagccgccgccgatccggggcttgatcacacggatccgggattttggaacatccagggcatgggcaaggatccttctcacatgaaaggtgatttgcgtggaagacaccatatttaaacgcccgtaggcatccagatagcagtaagcccggaaggtttccatcatggcctgctggtttgccttcgtatgataaacctgctccaccacataatcacactgctttaaaacctcatccacatctccgtgctcttccattccagaggcacacaaatttctcctattgtccgcacctaccggacaaaggctcttccagtcttcctcaggatgaaccagcacccggctgtcctttgcctgtttaaaatccagcacaggctccaggatttcatactccaccttaagaagacgcagggcatggtccaccgcatcttccgtttcaccggcaacgatggccgctgcgtctcccacaaaacgcatcctctgatccaggatcagcctgtcataggggctcggctccgggtaggactggcctgccatggtaaaacgcttctgaggtacatcctgataggtgagaatgcaggcgattccggccaccttttccgccctttccttgtggatctccttaatgagcgcatgggcatgagggcttctgagcacctttacaaaaagacagtccccgggagccaggtcatcggtatacacaggctttcctgtcaccagggccatagcatcctttttttgtacagaagtattgaccgtacgcattttataattcatcccttttctcccctctgctcaaatagttctttacggcccgaagctgccccatataaccgctgcaccggcataagtttccggccaggtactcttttattccctcatcgtcaagggctttttcttccttttccattgcaagcacattcataataagtcctgggctgcaaaatccgcactgctccgctccttccgcagccagataggtcccaaactcctttgcttcctgttccgcaccttccaaagtcaccacttcacagccatttgccctggcagctaaaaaggaacaggaaagtcttgactttccattgaccatcaccgtacaaagaccgcaattttccgtttcgcagccgcactttacgctgtagcagcccttccttctaagaagctggaataaggtggtgtcatctgtgatttcctcataggtcagttttccgttcagtgtgaattctatctccatttattcttcctcctggtccagcccttggaaaagccttctgatatatatttcagccaaatgcttccggtactccccgctccctctcatgtttgtaccataggaaaagccctctgatgcccgttttgcaagctcctccttaggacattcctggcttccgtcaagcactaccagctcagcttttccaggcctggcacctacggaaacataaagcttcccatcttttctggacgcgcagcaggcgattacaggaaaatccgtctttgccatacgctgggaagcataagccgcctttcttccatcctttttaatatggatacggaccagaatatcccggtcgctttttttcctgcagaactcctctaaggggagaattcctcccttgtacagttccacataagtgtcaagggccagcaggcaggtggtaatatcggaaaatccaaaccggccgaacacgcttcctcccacagtagccccgttgcggaactgaacacccacaatagaacgggtgcattccttgaaaacgccggaaaagcacgtgtccagcccttcatgggtctccagctggcgcagggtgcacatggcacctatggaaaactcatcttccgtctcctcaatcccatcaagcccaaggcccgataaatccaccagcgtcatcttcacccggctctgcactttcagccacatcatgcctccgcctatgacactgctcttcttctgattcagggcaaaagcctcttccaggctttccgcttttacataatttttaaatcgaatcattggaactgtcctcctgactcccaagctttccttctttatctgctaaccggtttccccttatctatcagtaagatgccattttatttattagcaataataataaatataacatcatatattagaaaaccggaaagagtatatcatactccttccggttttgacaatggttttataggttttttattaaattcgtcataatccgacaatggattctccgatcaaagcctggacatattcagggctggagcaaagacatcttgaaaacccttccgcggtttcagaaaagtcaattccaagggccttaagctttcctaagtccatggtcaaattcctgggattatccggatcccctgctttctccgggatcacaagctctcctctgttttcgcttttgtctagcatctgaaagaccttgcgtcctatttcataggtggaaagggagctttcactgccaaaattatagattccgccgggcaggtccatggccggctccatgttttttactacctcctgtacccaggtaatgccgcggtagtcgtaaaccgaaagccttattggatggttttgcaccatggaccgcagcaagttggtcaaaagattggagctgcttttaaggcccctgaccggaaaatcatacatccaggaaaggcggaggcagattgcctcaggcagaatctccaggatctcatcctctgcctgttttttctgggccccataaacattgatgagagggacctcatcactttccttattcggcccctttttcctgcttcccccgtaaatctggtccgaactcataaaaagcagcctgctgccattgtcacggctccccatggccatgttcaccgctcccttccggtttaccgcctcagaaagcgccggctgctcctcgcataccctggtgttggatatagcagcgcaatggatcacaacatcaggatttttttcttttatgtattccctcacagccttttggtccgtaatgtctaagcttccgtggccgacccggatcacatcataattcctttcataatatgcggccagcctcccgcctagaaaaccttccactcctgtaaccattacttttttcttcatccgtttccctccctttttaaacagtatatcacatcctttccccaactccaataatctgtataacctcttacaggcagtaaatccccatgcatagtacaagattccatatatatagaaagaatccggctttaagaaaatatccatgatcagctcgatcaggctctctgcaattacgccgcccaatgcattgccaatggcttcaacaaatgcaacctgttccgccaaaagctttgcccaaggggaacagccacttttaacggatatctgccgtctagttggtaaataagattatactgctctgaattgtccatataccgtacccccgcagttggttaacagcagaattttgtgctgttttgacaaaagaaaaatattacaaaatactttttggtcaacaaaaacttttagcttaacgaaaatgtaacgccctattttttaagaaaatattgccataataattaagctgattccgtccacaataatagatgtaataaacaatcaaggagggttaaccatgttagtagacggaaaaaatgaatgtatccaatgctccatcgataactgcgcttaccatgcaaaaagcgtagattattgcaccctggagagaatcaaagtaggaacacatgagaagaatcctaccaagaaagagtgcactgactgcgaatcctttaagaacgaggcataagccgccaaactctaatttcctcctaaaaaatactgcgcagcataaaagccgcgcagtattttttattatatttaacattgaaacacagccattatttcacaagctgttcttccaggttattgtatttcgcacttaagacaataatatcaatccgtctgttttgggctctcccttccgctgttgaattgtcggccacaggtttaaattcgccataacccacagcaataagcttatccggtgaaaaattgcatttattaataaaaagctttacaacactgacagctcttgccgtggataattcccagttggagggataggtactgcgtctgatgggaacgttgtcggtatggccctcaatacgtatgtaattatcaatggtatttaaaagtcctgccacctcaaccaaagtatcctcactttgttttttaatttccgcacttcctgagtcaaagaatatggcattattcagtctgatgacaagtccccgcatatcgatcatggttgataccgattgatccatgccattgccgtggagttttgtatcaagttctgtctttaggttttccagctttttaagttcatactctcccataaagctctccagctcactttgggtctcaatatttaacggaccgcctgactgggcgccatcgccgctggaggcatcttgcgcggctgatttggaaacataatctttattcatcatggttccggcaaattgctgggaaatctcctgtgcttttgcagcatctatcttactgacagcaaaaagtacgataaaaactgccagcagcagggtcatcaaatctgaatatggcagcagccatgcctccccggcttcttcttcctgatgtacatgctctctcttttttgccatatgtatcaccctattcctttttatcctgttccgttatttttttctgcttagatttcggaagagcggcaagtaacttttcccttagaataaagggagaatcgccgtgctgcatggataatacaccttttatgataatttctttcgccattatttcctgctggcttttcactttcagctttttggcgaatggattccatagaacgtagccggtaaagataccaagaatcgttgcgataaacgccgcagcaattgcctcagccatccgttccgtatcattgatggaggacatggcagcgatcaaaccaaataccgcgcccaaaacacccagggtaggagcgtatgtaccggctgatgagaaaatacttgcattgatctcatgccgcttttccattgcagcaatttcagtttctaaaatatcctcgatcaggtcttcaccggaaccatccacaagcagacggatgcctttttttaaaaaggggtcctgaagttcttctgctctggcttccagggataaaagcccttctgaacgggcttgctttgacaattcatacattaattcaatcatttcggcttcagaggttcctttttgttttgtaaaaaggattttaaacagcgatccgatggatttaatattttctccgggaaatgagtttaaaattgtagcaatagtcccgacaataataacaaaaaatgctgccgggtttatgagaacagtaaactcaatgtgtttaaaaatcatagcgccgacaacggcagcaacaccaactataacgcctaggatggtcgttaattccatagtttctcctttgtatatctaagttattagtgatccatgaggctgaactcagcaactcccatacacccagcccgttatagtataatatatttgttaccgctccagtattaaataattgttaaaaatatgaaaaagctgccaggaaagaatttatatgggatatggcacatgataactcatttcatgcacagtatctgatataaattctctcacgacagcttcttttttatcttttcctattcatacaggggatatttttcacagatctttgtaacttcacttctaatgtaatcggctttgctttcaaaatccgtggcagccagccagatacactctgcgatcttttccatgtcctcttcctttaaccctctggatgtaacagccggagttcccacgcggacaccggaagtcacaaacgggcttctgggatcatttggcaccgcatttttgtttaaggtgatatatacttcatcacagcggttctgcagttcctttccggttacctccagccctcttaaatcaatcagcatcagatgattatccgtaccgcctgtcaggatgttgaatccctgtctgatcagggcggcagccagagcctttgcatttttcaccacctgctcctgataggtcttaaactcaggctttaatgcctcgccaaagcaaacggccttgccggcgatcacatgctccaaaggacctccctgtgtacctgggaaaatggccttattaaagttaaatttgtccgctgcttcctgatttgccagaatcattccgcctctgggtccgcgaagagtcttgtgagtggtggttgtcactacatctgcataagggatggggcttggatggattcctgccgcaaccaggcctgcaatgtgagccatatccaccataagataagcccctgccttgtcggcagcctcccggaatctcttgaaatcaatggtcctgccatatgcactggctcctgccacgatcagtttcggcttatgcaaaagcgcaagcctttccatctcatcataatcaagaataccctcatcattgacgccgtaaggaactatgttaaaatacaaaccggaaaagttaacgggacttccatgggtcagatgaccgccatggtttaaattcatgcccataaccgtatctcctggcttaagcatggcaagaaagaccgccatattggcctgagccccggaatgaggctgaacgttggcataatcacagccaaatatctgcttcgcacgctcgatggcaatggtctcaacgatgtccacatcctcgcagccgccgtaataacgctttcccggatatccttccgcatacttgttggtgagcacagttcccattgccatcatgaccggctctgaaactatgttttccgatgcaatcaattccagattccttctctgccgtgcgcattccttttcaatggcttcacccacttctttgtcatagccggtgataaacttcattacctgatttaccatgtgcataccctcacttttccttttgaatattaccaacttccattttggtagattataagccattcttcctaacaatgtcaaggctttctcttcttcctctttggtcttcagcatttgtctataaccggtaaactggggccgattccatttatcctgcccctttccctgtcatacacaccttgaaatcttataattttttatcacaatctgcagcgacttatttccattgtattcatttacggaaggataatatatcacatccaggatccggctgtttcccagctcttccataaaggaatctccgtcgccaaacagcagggcatccactggcgtgccctggtccgttgcaagagaaaacttcactgcattcctgttttttcccaaaacacgtacgcttcggatatgaagtcccttctgtgcgaacaaaggcttttcattgccctggccgaatggctccaaaagctccagttcctggatcaatggctcatttatgtattccaggggcataggaacatcgatccacacctttcgtatgaaatcctcggacgtaagccttgcctgttcgtttaagcgtctccggaattcatccacatgttccttaagaagggataagcctgctgccatgggatggcctccgaactttaacagcagctccttcacatttaccagagcttcaaacatgtggtaggtttcaatggagcggccggagcctttgacgctttcctccccatctgttaatacaaaggcaggcttttgaaaatgttcccgcagccgcccggcaatgatccctgccagcgattcatggcagtccggcaagtataccaccaaaaccttatcttcgctgtaaagggattccacctgctccaccgcctggctggtccctgctttgtcatgtcctttcgcctgtcattcagttcctttaattccagtgccatctgatctgcttcctcttcattttgacaaagaagcagggataaggccagttttgcagtctgaaggcggcctccggcatttaagcagggaccgatcacaaatccgatctggtaggcggttatatcatccttatccagatcattcctttcaatgagctttaacagtcccaggctctttgtctgcccatccgtttcagcccttcctttacaatgatccggttctcatcctgaagcttcatcacatcacctacggttgcaatggctgcaaattccaccatctcaagccatttctccattggcacgtgaaattcctcataaagagcctgaaccagcttataagccaccattcctccgcagatatcaggatatggataggagcagtcctcctgctttgggttcaccaccgcatctgccggaggcaggacttccctgccatcctccttcatgatatcatggtggtccgtaatgagaaccgtaaggcccagctcctttgcaagcctgatctgcgccactgcggcgatcccgttgtcacaggtgaggatggtatctatgccatcctctgccgcagcccggataatggattcattgatcccatatccatcctttaaccggtccgggatctcatagtccaccacagcccctacctggcacagggccttgtataaaaggtaggtggagcagacgccgtcaatgtcataatcccctacgatcctgaccggcttttgctgccttgtcttttctcttaggattgccacggttttatccatatcctttaaaagatgaggactgtataaatcctttattcctccgtttaaatacttttccaccgcctcccggccaatcacatcccggtttcttatcactctcgcagttaccggcgaaatgtggtggcattttgccatttcatcaaaatcagccctttttgtctgtagcatccatttctcttctgccatgtttcgttatctccctgcaaacggctcttccggacagttcattcttatcattttcttctgtgccggccgatccgcctctttcctttcgttttttcgccgcatccagccggctcatcaagctggtaatagaatagagaataggggcaaaatccccgcggtacgcatgctcgcatgtggatttcacctcaaaattctcgcttccgatctccctgaataaatatttctcatcatcaatgatgtatttaagccgcttaatcaactggttgacggaatcggtcagaattccgatctcatcttcggaacggtaggaaaggtacacctccaagtctccattggcaactctcctggtaccttccacaagggccttgacaggcttgtcaatggcaataattatatagatcaccaaaagggaaataaccccgccgatcaggcagatggttatgatctttatttttgcaagctggtcatagagcctgtcaccttgaatgctggccgcctcagccccctcccggttaaattccgccacctttaaaagtccgttgctggcatcgtcaaataactgtccggactctcccatgatcatatcaaaggcttcctgggtgtgattttcacggcttttcacaagcagattatcactgtactccaaatacttcttccattctccttccgcctcttccatcagcttccggtccgattcattggcaatataattctcataatcttgaaacccctgggcaatctcttcccggatctggtccatttccccttccaggcggtccatatccttgttatccacggtgatgacatggttatattctttaatacggtagtctgatgtcctggtgttaagctcctcggcaatgatgatggcagggacccaggactgtgagatttccgtgctggcctcattgatccttcttgccgttatcacggattccgttcccatgaaaatcaatcccataatgctgatccctcctaaaaacaggagctttgttttaatattaatatttctgatagatttcagcttcatagcgctttaattctctcctcctcaaccggtaatccggtaattctctctccacaacctgccaaaatgcaggggaatgattcatatgaacacggtgagcaagctcatggaccaccacataatctgccagctcttccggaagaagcacaagcctccagttaaagtttaaatttcctttggcactgcagcttccccaccgggtcgcctgatcccggatggcgatccttccatagtccaccttcataattgcagaccatctggctgtcctttcccccagatactctctggcttcctgcctgtaccaaagcttcacagcctctttaacggctgtttcctggtcctcccctgaatatggtcccatgggcccggagaccaccaggctttcctttgtatcctgtatataaaacgtctttcttttataatcaggccgcacatgaagaatcctgctgcttccgtgaaaaagcacgaaggcaccttccgcccaatgaaaggcctcccttcgctccgacgctttccgaacctttgccacctgcgcaaaaacccattccctgttcttctgtaccagctcatgacctgccttaaagggcaggcgccctggaagccttacgaaaacctctcctgttttcgtgacctgcagggccagggtacgcctgtccgattttatgatcccgtaagagcacgtggttccatcgtcaaaggagagcatgcccgtttcctttctgctttcatgattgcccgcttccatcgatctgattcccaaccttttctcttcatcttctctctgtcatatacttaaacccgtaaccccaattatagcgaataaatacaaaagaaacaatacatatcttaacggccggaaacataaaataagagaacccggcaggttcccttatgactgtctctcttactaaccctcttcttcctcatggggaaccgtgggatatctctttcaatctttcataatccatgatccggtaccccttatcttttttaaggatcccgtcatcacaaagcttctttatgacaaacagtatatggcggtagctgatgttcatatactcggaaacatccgtgtggggtatggtgtatttcccattttgctgatactcgagaataaaggaagccagccttttttccagggaataatttaagtattcactcatccggcagctcctgatcatcagcttattggaaatataggaggcaaaataaaatgatatttccgcctcttttttgcagactttctttaactgatccagctcaaattccaggcagaccacatcgtccatcaccttattttccttgatataatcctcgctgcagaataaggaaagctctcccagccagtcgcccttccctgcaaaatcgagaatcgaccggcgtccgttctcatggtcaatatagattttcaccattccggaaaggatcaggtagcagcgagtgatcttgtcatccacatgaaaaatattctttcccgccggataatgccgttcctctccggccgcggccagactgtccggtatttcatacatattgtattttttcattttttttattctccatatgataattctcatagtcggctgcctgctttttatggtatcatattcccgaggtgaaaacaatgagcagaaaaaaacgaaacgatttaatcggaaccatcctatcctttgtattctttggctttggaatatccctgcagctgaaggcagccatcgggcaaagcgtcttaaacgcactggcagtgacattatcctataccatccagatgaaggtgggcaccatactcaatgggatcaattccttgttcttcatttcctatttacttttaaggcgttcacgtttaaactataaagacactatacagattattgccaccattgcaaacggctatatcatcaacctgtttttatatcacttgctttccatttttaccgtggaaagctatatttaccgggtcatcctttatttgaccggacttgtaatcgcttccatcagcctgggagccatcctggcaatcggaatcgtgaaattcccgctggaaagcctgtgtcttgtgatcagcgaatcatataaaaagaattttgccgctgtccgcatgagctttgatgtgatatttttgatcgtcaccctatgcctgaccctgttatcacgcgccccgctgcaaataagggaaggaactgttatcagcgtttttctcttatccaccctgcttgggatctgctatgaatttttcaagaaacatttaactgtggaggactaaacatatgtatcagatttttttactggatattgacaataccctgctggattttgatgccgctgaagaacagagctttaaaaaggtgatcaaatcctatgatttggaatataaagacgaaatgcttccccaatataaaaagatgaacaggcatttatgggatttgctggaacaggaaaagataggcagagaagaacttctcaatacccgtttttcccaattcttccgcttttacgacttagaaatcagcggagaggaagcagaagggcgctaccgaaggcatcttggaaacagctctgatttaattccaggcgccacggaaaccctgacacggttaaagcagatggggaaacaactgtattccgcatcaaacggagtttactccactcagatacaaaggcttgagcaggcaggccttctccatcttttcgacggaatgttcatatcggaaaaagctgggtatgaaaagccatcccttcattttttcgaatattgttttgagaatatcccacagctggagaaagacaagaccattatggttggagacagcatatcctctgatattcagggtgctgtaaacgccggcattgattcctgtctcttctgccgttccggccggcccctgcagtccgaagcaacccataccattcaagatctttcagaattgataagcatttaacttacctttattcaaaaagcccggcagcaaaaactgccggactttctgtcattttctcaaatccccttcatgaactttgtgggggatttcaaagtgtattttttaaataccgcacaaaaatgcttgtaatctgtaaaccctgttgcatcggatacctcaccgatccggtattgcccggtatttaacaggttaatggcctgggaaatccggtatttatttaaaaagtccagaaatgtctgtccggtcacctctttgaatttccggcttaaatagctggcactgactccaagcttatctgatatggattccacgctcagcttgtcccaatatcctgatttgatctcttcaatggccctggaaacatacttgttttctgaagggtccagctgcatatagtattccaggttcatgatccctgcctctgattccgcctgctccatcacatattccacctgacggctgtttgctatttcctctcccagccttttcataagggccgcaagcttctcctcatccacgggctttagcaaatattcgctgaccctggctgcaatggcccttcttgcatagtcaaactccgcatagctggtaagaagaacgcttttaaatttcacgctcttggaagcctcctttatcatctcgatcccgtccatataaggcatgcagatatctgcaatgaccacatccggtttctgctccagtatctttaaaagccctcctggccattggccgcctcagccaccacaacacagtccatccccatccaatctgtggtgtaaatcagccctttgcggataatatcctcatcttccgctatcatcacccgtaacattatgattcctccctttgtgcgggaagggtcaccaccagcgttgtgcccagcccttccgcactgcgtatctccactccgtatggtcttccgtaaaggatcctgcaccgtctgtgtatattataaagcccggaatgccttctgttgttttcctcctgctccaaaagagcctggatctcacttaaaacccccggagtcatcccgatcccgtcatcccggcagatcatgatcagccggtcttcatgaatataggccttaagctccacctttaaattttcctggttgccgaacccgtattttgcggaattttcgatcatgggctgcagcaccagcctggggatccggcaggtcagcgcctccgcttccacgtcaaccacataggaaaacctccggttaaaccggtattttaaaatcatgagataattctccaggtgttctaaatcttcttccagagtcacctccgtcctgctgccgtctaagctgtagcgcagaagatttgataggctgaacaccattttcccggctgtctccggctggatcaggcacatataccggatattttccagggtattaaacagaaaatgagggttaaactgggattccagctgcttgttctgggccgcagccaccagctccgtcatcctccggttattttccatctgcagctttaagctggcaatggtttcccggtaagcatcggctatgatcttgaattcattttcactttctatttcaagagaggtgtctaaatttccctctcttgccatctccatgacatgaagaaggcggtaaaaatccctggtttcccgttctgtcacctttttcgtgctgatcagcacccatatggtcatcagcacaagagccgttataatgagggcactgctaagtcccagggagaacacgatattctggatatctgtcaccgaatagactaaaaacatgctgttataagacgggtggacggatacgagaaacatcttcttttcataggtcagatacttttccgccgttttaaggacctttaaaacctggttgctgctgctcaccagattataattgctgcttaaataaacccagccaaaccggtccgcaatgatggtctggctgtccgaccggtccagcaccggcttaaactggctgctgttaatggtaaaaaccagatatcccgtctttttatccccctgcatcattgccatacccatggcaatatcccggtcagagcccttccaggcctccatcaaacgcaccctggtttcccctggttcctcatccattgccccgaacattccccagtgcacgccttccctgcctgataaatattccgggacatccgttctggtggataaaagcactctcttttctccgtcaaaaacatacagctccgccttatatcccagctggtcaaacagccggtaaaactcctcaaataccagcctttgcccggcggcccctgagctgacattaaaaagcaagtcagaatccgacagagccttaagcttctcttcgtatccggcaaggactttctcaagttcctccgccaccaaagcattgtgtgactcattcccgctttttttcccgtagagaaggaccgcaagaaaaaccagcgtacagatcagggtaaagcccaccgccggaatgatggcatatcccaggatcaggcggcgcagctcctctttgaaatatcgtccctttttcatgctccctccctattctaatccagggttcctaaaaagatttccgaaaaacggttcagccattcctttttgctctcctttaccacagcttcctcgtcataaatgatatggatcgcctgcttatccagaagatactccggttcattcacatccgttcttacagaacgccttccaaggctttcagagatgaccgtctgggcatcctttcccgtcacaaaatccacaaactgctttgcctcggtcaagtggccggaccccttgatgatgcataccacatcaggctttgatataacaccttccttcatatacaccaccttgaccggatatccggagccaatgtaatgggcagccccctcttcaaaagaaagacccaccgtataccgtccctcggccaccccctgatatacctctgaagagctttgaagaagctttccgccaaggtttctgcaaaaggcctccacataatcccagcctgcctccggatctccgtctcccatagcataaagcatgttgatcagatgctcaaaggcagaggatgaggtggaagggccgcacatggcgatctttccgaaaagctccggcttaagaaggtcctcatatccctcaatggaaatatccccggccagattggtattgaccatgagaatgctgggaacatccgtaaaccgtgttaagttcccttccttgtttctgtagtcttcctggatcatgggttcatttttgctgatataaggctcaaacaactcactttttgccatggtagtagacagggagcctccccagaaaatatcgcacttaggttccttcctgtcctccaccatctttaacagttctcctgtccctcccgtgcatacctccaccttaatcccggtctgttcttcaaattccgatacaatgggattaatgaattccaggggatgagggcagtatactaccatttccccatccccctgaaactctgtgggcactgtcccggagccgcggtcgcagcctgccagaaaaccaatgcacagaagggctgcggcacatttgatccagcttttcataatcccggcttcctgcccttcaaacttattattatcattctaacacagtactacaggatgtaaacaccctttggatcaaaatccagacaagccttttctcccacctcataaatccttctgttgaccggattatagtccgtgatctggatctccatatcacctaccatcacctgataatactgataggaacccataaaggtagacaaggtgaccagaccctctaaaagcccctgctccgccagaatcgccccctccggccggatcaccaaggttgcctcatcccctggatgggccttggcaaagttgtttacctggaactccctgcccgccacggatatcatggccttttcgccttcttccgacaggacctttgccttcaggaaattagcttctccaataaaatcagccacaaatctggaggccggatgataatagatctccctggggcttccgatctgctccaccttgcccttgctcatgatgatgattttatcggatatactcatggcctcagactggtcgtgggtcacataaatggccgtaatgccgaccttttgctggatcttgcggatctcagtcctcatggtcaccctcagcttggcatctaagttgctcaaaggctcgtcaaagagcaggactcccggctcaatgaccagggctctggctaaggccaccctctgctgctggccgccggagagctgattcgtcatacgggattccatcccttccatttccaccagctttaatatgttcatgacccgttccctgatctcttcctttggaaccttccggatcttcagcccataggccacgttgtcaaatacattgtaatgaggcagaagagcatagctttggaacaccatggcagtatctcttttattgggggtcaagtggttgatcgcctcttctcccagatatatttctccttcatcagggctttcaaaacctgcgatcatgcggagagtggttgtttttccgcagccggatggccccaaaagggtgacaaagcttcccggctcaatgtccagggtagtatcctttaccgcataaaactccttgcctgtctttggatccatatatatctttgatatgcgctccagccgaacgccttttttctgtttatccattttatcttcctcctgtttcctttcttccgcccacgttctatgggcagagtccgccccgctctatcgggcgtaaaggtatacccgcaaggtcttcagcttattcctggacttccttcacagctctgctgacgccaaagagcttcatcagagcgttcatgatgagaaccgcgccataggtaatgaggatcaatacggtggcataagcacaggctacgccgtaattccccttttccgcctgctcattgatctggcaggtgatcagcaagaattcaggcgttaccagcagaatgatcgcagaaattgcggtgatgctgcgcacaaacgccgttaccagaccgctgaaaaaagaatcctttataagaggaagggtcacggacatgaataccttggcagaattggcccccatgtcataagcggattcctctatggatttgtcgatctgccgcagggcggatatcccgcttctggttcccgtaggaaggcttcggacgatgaatacgatgatcagaataagccctgtcccgtaaagaccgctcatgattccagatcggaacagcccgtttgcatatccccggatataaccgataccaagaactgttccgggaacagccatggccagcatggaaacaaactcaataaatcccttcgccttaaaccgcttcttgacaacaagataggaaatgaccatggaaagaaacgcagtaagggggcggcgatcagggacagcacaaaggagtccttaaacgcctttagtccgcttgtcttaaacatgtattgaaaccacttagggcttaagctgtaatcccttccccacagagtaaacatggcgccaaaaggaaccatgatgtacatcagcagcacaaaggccgcaaccaggccgcagaatatggtcagtggaacggtcacgctcttatcctctatgagcatcctcatgcgggaagcctttcctgtcaaagtagctgccgtcttcttttccagataatatttctggatcaggaacagcaccactgtcagggacagcaaaaccactgacatggccgctgcacctgtggagtcataagctcccgtcacctgtaaataaatggtggtggccagggtatcataggacccgcctatgagcatgggatttgcaaaatccgccacagactcgataaaggtcaccagaaaggcatttccaagtccgggaaggagaagcggaaacgtaacactggaaaacaccttccatctggtcgcccccatatccctggtggcctcttccaaagaaggatcgatgtttttcaaaagtccctttaacattaaatagcatacgggaaaaaaggtcagagtctgaacaatggcaattcctttaagcccatagacattggaatcatatatttgaagcagggaacggctgattaagccgcttctgccaaaaagcatgatcatggacagagataatacaaaaggcggggacaccaccggaagcatggaaacaagcccgaaaagcttttctaaaatcctggttttcagcttcacatacacctcaacataagcaaacagaagtccgattgccgtagaagtgattccggtgataaatcccagaacaagggtatttttaaaagcattcttaaaccggtccaggttcagaactcttttaaacacgtcaagagtgacggagccctccgcataaaagctgtctaccaacagcataagcagaggatatagtataaacagtgctaaaaaaacaagcagaactgcgatcatgctcaccaaaaccgggtctgaaaaaaactttttgcgctccagacgggcgctctgcaagctggccatataaaatcctcctttcgtcattccaggcaggagtcctgttcccatcatgtaaaaaatgctgcgtaatggtctattacgcattacgcagcatgttaatccatacagccggacgtttacttcctgccctctgtctccttactgtgtcaggaaacggccggcatccgccttgtcagcagagcttcccagggcttcaaagaaatcttccacatattttgcactgttttcctttgcatcttcaaaatcataatcaatggtattgttcatatccagaccaaactgttcagcctctttaggctgtgtggcattttttaaaaccaggaactgataagctccgttttccttggcaaggtccacacactccggtgacagggcatattcgatccacagctttgctgcattgggatgggtggcgccgttaaagatggcggtggctcctacctcaaaggatgttccatcctcaggaacaatcagctgaatgttgtcatatccctgaaggatctgataaattccgtcatgaaggaaaccgattccaatgacacattctccaggtccaaccatcttggacgggccggagcctgattttgtatactgggcaatgttcttgtccagctttttaaagtattccattgcttcgtcatggcccttcatctggatcatggtattgatcaccagctttgccgtgcctgcagtgttggggttagacagcatgatcagtcccttatactcctctttcgtcagatcatcccaggtcttcggagcttccaggccaagcctctctaactcttccgtattcaccataaagcccaggattcccttataaataccataccagcaattagtaggatccttatactggtctccgatgaggttcttggcattcaccgcatcataaggcgttaacagccctgctgcaaccgcctcattataggggtctgtagttccgccgaaccatacgtctgcagaaggctttccggcttcctcagataccttggtataaacctctgaggtagaaagtctctggaactttgtcttaatgccataagtcttttcaaagtactggcaaactgcagccagatgttcctcttcacaggagccgtatacggtcaactccccttcagcctttgccgcctcaatcaaagcagataagtcctcgtctccccctgactccttcttctcttctcctgcggccgcagttgtctctgcagctgttgtctgcgcctcctttgcagtctctgcctttgtctctgccgcctcctgcttggagccgcatgcagtcagactgagcgctgctgtaagcgccagcaaaaataccgttctttttttcataatagatatccctccgttctttttctgtgatctaatcatagcagaaaaacaccagagcaaataccgaaaaaccagtaataatgtcgtgatttttgaacttatccatgccttttttagtaaaaatacacacgtccgtttatcttaaaaatctcccctccagggccagaaactgatccaggatcatccggctaacccttgcaccgaacacagtggccggatgggccggataatacatggcatcagaaaattccttatggaacataacgatggcataaggcccgtaaggagtaaacacaagacctccgtcattcctgcaggcgtccatgcttccgcttttagaggctacggtgattaggatatcatctgtgttgtcgctgtccatgtaaaagggaggaaagtctttggtgatcatactgttataatgctgcttcttaaagatttccagcatcttctcatccgctgtccggctgataagctccccctttgccaggcgggtaaaaatgccggcgtaatcccttggcgtgctggtccccagcctgtcgtacctttcaaaatgaatggggttgtagagcaccgtgtccctgcatcccagggctttgatgcaacggttaatggtatccagccccagatagtcaataatcatattggttgcaatattatcgcttacaatgatcataaaagtggctgcatcctttacccgaagccttgctcccggctccagagcggtaagcacgccgcttccctccaccacatgctcctccttgtattcgatcatatcctcaaggcttttatttcccttttccacctcatcaaacaaacatgccaggatataagtctttatggcgcttgctgtttcaaatgcttcatctgggtgaacggcaatcacgtttccgtggaaatcatctaaatagattcccattttcccgtcatagctcatgacctccgcttcgattcttttctctaatgtaagtctggaatccatgttatccgaccctttctcttaattgattaatgaggaatccgcaaggcaggccctcccgccgaagatactccccgacgcataccagctttccgccagatccgcccggtagtcctctgcctttggatttaagctgttgatcaccacgccgccgctgccgattcttccagtggaatggatgtaggctccattccccatgtacatggcaatatgtccaggaaaatacataagatctccggcaagcatctcatcctttggaatctcatgaaccggaaatcccggctctatcctggcatcccggtaggtcagtatcccgtttaacagatagctctccgaggtcagcccggagcagtcaatacctgcggtggacctccctccccagcggtactgggtccccagatactgctttgccgtctccaccaccgccttgcggaaggccgcctcatccacaatttccttctgtggaagctcccccgtccacaatcctgactgggaaaattcctttggccgtaaatactggttcctcatataacccacacgtccgtccaaaagctctaccctagcccagccctccacttccgaatcaaaagaaagcacctttaaaagagagcctttaaaaaggcttaaaagccgtaccccctggaccttgggaaggaaaacgatatccgcgtaaaccccgtctgtgaccataaggtttccctcttcccagcccttcagttcatcaaggctcaccgtttcaatctcctctttcctgataaaaccggaataattgtaaaaggtccgcaccggataaaatccctccacctcttccccggtgatcgtaacccccatcccatacagcccttcatctgaaatagccgacaccgtttctccaaggctgttctcctttatttcttccggcccttcccaaatggcggcaaccggtatttttacaatcccgtaagattccatcatcatcctatcatctcctcctgtccttcctgttacagttcttccggcacttcatgaaccgctgcgttgcacaccggacaattccccatttccatgggaatgtaggccgcatttcactcataaaacggaccgtccatctgcctatagcagaaatgtccaacaatataacatgtcacagccgtaaagaaaccggtcacaccctttactatattgatatgtaccgcatttttcattattatatggtcagaaatgcggaatgtcaatgataccagaaaatatgggagatcgaaaactttgcatcccataggaaaaatagaatcccgttttcacagaacgtaatttctgtaaaacaaaaaatacacccctccccgcagcgcacagccttaattccttaagctgccgcctcagggagggatgtatcacaattatctcaaaactccatcaatgatcaggattattgatagtatttccgagagcctccatcctcttcctttaaccggaaccggttcacaaggtcttccagcaggctggactggctggaaagctcttcgctggcggccgcagactcttccgctgtagcagcattggtctgtactactgaggagatttgatcgatccccagtgcgatctgctgcattgcctctgactgctgcacggaagcgtttgaaatactttccaaatgaccggccacctcttccacatggcctgcaatattagacaaggattctgcagtctgtccaacaagaccggtcccccgcgtgacggaacgtatggagccttcaatcagcccggcagtattatgagtcgcatctgccgttttttgagccagattccgcacttcatcagcgacaacggcaaaccccttgccggcgctcccggctctggccgcctccactgccgcattcagcgcaagtatgtttgtctggaacgcaatgtcatcaatgatctttaagatgctgttgatctcatttgtcttagaattgatctcctccattgcgcggatcatttcctgcatctgcctgtttccatccaaaacactggaaaccgccgccttggaaagctcattggctctgtgagccatttccgcattggatccgatatgattggttatatcgtttatggtggaggacagctcttcaaccgatgctgcctgctccgtggccccctggctcaaagcctgggcccctgaagccacctgaccggaaccagacgcaatctgatccgatgacatcttaatctgggccaatgtctccgtaagagtccgggaaatatttaaaagagccgtttttatggtgctgaactctcctatataatccgattccagttcaaatgccatatttccctgggcgatctggtttaagacggaagaaatctcctcaatatattttttgtattccttaagggtcacgccgatcttccgaaacgcctccaccagctggcccacttctccgtcagccttgatctgaatatccacatgaaagtttccttcagaaatctcctgtgcggatttggttacggctttaatgggtttggcaatgctgttgctgatcaggactcctgcagccagtacgattataaatacaacagctaaagtaaaatacatgatcctttccatctgatacacggttttaaacagagctgcctcagatactatggaaatataattccagctggtcttatcagagcggacgctttttataaaatacggcctgccccctatgtcgatcttctgaaagtcagcattttcgctgactgctttaagaaattcttccccatacgtctcagaaagttttttaaagttattctccgtattgctgggatcagccagaatagtaccgtcgccggtgaccagcatataatagccatttgaatcctttgtagccatctcaaacagctttgtaagagcatttaaactcatgtccatagccataacacctatgacgtttccctgagagtcggtaatcgcctgggacgcacctacgatcacaatatcgtccgttgcaaaataatagggttcccccagaacaggagcgccgggagccgcctttgcattgggataccatgggcggatgcgcggatcaaaggcagagtctaaatccgagtccggatactgtatgtaaccgccgctttccgtgcccatataaatatactgataatccggatggctttttccgaattccgaaaagcttttgaatatttccctctccaccggtccgttttgccccggtgtcatttttatagaggaggtgatatcggtgtagctggtaatggtttggtccgctgtctgaagcagttccccttcggcaaaatagcggacattattaagcatatcattaaacacggcatccacattatcgtttaccaaagacagctgcttgtttacggaggttttctgctctgacagggatgtgctttttaagcttcttaaaagcagtaaactaaagcccaggagcgggacaattgcaaaaaagaccagaagaaaactcagcttaaaccacagtgtcttaaaaggatttaccttcatataactcccccttcttttgtatatcttgaattctcctaatcatagcaaatatcaacctgaaaatcaattgattacaccgtggttcccggataatataattttattttctcatgaccctatattaaaattcattatattctctcctaaaacaaagaatcttctttgcagactctcccgccggagcgccgttgcttttacgcaaagaaatccggaagaaactcccaaatgagacgttcttccggatactgccttatttaatctctgtacaattttttatattcttccgcttccttccggtttgccagcacaaaatgctccggccttatctccttccaggaaggcttttcccatgaataatcgtgaagcataggatcataaaccagaagcttcttctccttctcatgcttcggatcaggcatgggaattgcagaaagcaaagctctggtgtagggatggaggggatgagtgatcaattcctcagtttccgccatctccacgatctctcctttccggattaccgcaatccggtccgtaatgaaacgcataacagacaaatcatgggcaatgaacaaataagtaatctggcgctttttctgcatatccgcaagaaggttcaaaacctgggcccggactgacacatccagggctgaaataggctcatcagcgataacaaactccggattcataatgagggaccttgcgattccgattctctgcctttgacctcccgaaaattcgtgaggaaaacggcttgagaactccggcagcagaccgacatccaaaagagcctgatccacccgttttttcctctcgctctcatccaatcccttttctaagttcatcagcccctcgctgatgatgtaatccaccttggccctttcatttaaagaagcctgagggtcctgaaagatcatctgtatttccctgatcacctgacggtccagttcagccgggattttcccgtttattttatggcctttgtaaagaatctccccgcctgagctgggaacaatcctcataatggcccggccaatggtggtctttcctgagcctgactctcccaccagcccaaaggtttctcccttgtatatcttaaaattgaccttttttaccgcttcatacttttttctgcgctctccaaaggtcacatccaaatcctttacatctaataatacttcccgttccatcagatcagacctccattcctgattttagccaccacttcaggcgggtccagcttaggcgccctcgggtccagcagccaggtcttggccttatgggtaggcgatacttcaaaataagggggctgctttacaaaatcaatcttaagggctttgggatttctgggcgcaaatgcatctccctttacctctgtatagagattgggcggagtgcccggaatggaaaagagatctgttccctttactcccacctgaggcaaagaagaaagcagagcccaggtatagggatgccttggatcataaaaaatatcctcgcatgtaccgatctccacaatatcaccggcatacataacagccacccggtccgcaatattagccaccactcccagatcatgggtgatcaaaataacagacaatttatacttatggcgcagttccttaagcaaatccaaaatctgagcctgaatggtaacatccagagccgtagtaggctcatcgcaaatgagaatctgaggattgcaggcaatggcgatggcgattaccaccctctgcctcattccccccgaaaattcatgaggatactgggaaaaacgcctttccgggtcctgaattcctacgtccgtcagatatttaagggtacgcttcttagcctccgcccgattcaccttctggtgaatgagcacggcctccataatctgtaccccaatggtctttaaaggattcaaactggtcataggatcctgcatgatcatggcaatctcatgcccccggatattaagccagtccctttccctcttcacattagtgagggttatttccttcccgtcatcagacccgtaataaacggcatttcctccatccacacgcccgtttttctccaaaagccccataaaggacttggtaaacacagactttccgcttcccgattcccccacaatagccagaatttctcccttatataaatccagggatattccgcgaatagcgtgaagggttttccccctcagctcaaacttaatatccaggtcctttacttctaaaatcttctcttgattcattctggtcctccttaaacgtggttcttgggatcagcagcatcggagaaagcgttgccgatgatataaaaggaaatggtgacaaatgaaaggatgatggtaggataaaccagctgataccgcagagccgggctggtgatcaatgcccttccctcattgatcagatttccaaggctggggatattgaccggaagtcccagaccgatataggtaataaacacctcatttccaatggcagcaggaatggtaagagccattctcagcataataaccgacaccagatatggcagcaggttcttaataataatccggctcaccggagttcccaggcaacggctggcaacattataatccctgtccctgataatgagaatctggttccggataaaccgggccatctgaatccagccggtaagacacatggcaaacaccagagtcttaatgctgggctttaaaatataagaaatcagaatcaggacaatcgtatttggaatattgtcaatgatgttgtaaacttctgttaaaataaagtctgctttcctcacataaccccagatcacgcctacggtgatgccgataacagcctctgcaagagccactgacaagccgatcatcagagaggttcttgtccccgcccagattctggcccacaagtcctgtccgatggagttggttcccaaaatgaattcctctcccggaggcacatttcgaaactgcattcccgacgcatcattgatgattttattaggatcgtactgccccggtaaatagggctggataaaagtaaacgccagaagaagcgctaaaagtatcaaaaggataaaggctccccggtttttcagaaaggcatgaagagtgctgttccagtaagaataattgctgtaccccgtcttctccacttccatctcattgaattcctgaaaagagaataactctgcctcctccacggtctccataaattctgcttcctttgagtggcggtatgaaaactgcttcatcatctgtcaccttccttctttcccagactgattctggggtccaacagcaccataagtaaatctccaaacaaaagtcccagaacgcctacacaggcatagagcagaacaattccctgaaccatggtattatcatgctttttaattacagtaaccagcagacctcccattcccggaatgctgtaaagagactcaatataaatagaaccgatcaccgtatttaaaaatgccgtgggaatatactgagccaaaggcacaaaggcattacggaaaatatgcttaaacatcacacttccctcagacattccctttgccttagctaatttcacataatccttattgctttcatccaccatataccgtctcagccacatgccgtaaaaagcgatgtttccaagagacatggaaattaccggaagcacccagtatttagggtcattgatctgaaacagcagtcccacattaagcagcttagttccataaagctggatatacaaaaaataaaccgccgccggcaccgcctggatgcagacaataaaaagggttccgatccggtcaaaccaccggtatttatacctggccatcaaagcgcccataggaagtcccgccagaagagacaccaccatggaccaggaccccaatttaatggaaacaggaatcttatcagccaaaacctgtgacacaggaacattggccctgtaaattctggacatgcctaaatctccccgaagaatatccttgaaaaagcgaagaacttgaaccggaagagggtcagtcagccccatttcctttaagccaacctgtatttgcttttctgtcattttatcgaaattctggaaatacccttcaatgggcatcagacgaagcagacaaaagaccacagtcagaataatgaccagtgtaagaagtgaacgggcgattctttttcctaagtactttatcatcagtttttcggctccttttatataattttcttaatcaagtattgttcttcctcatagtaaaaatactctctgaaaaagacgtactgcgcacatctctttcagacggcatttttccgccggaccgggaaattttacgcctggtccggcggtcatttttacagtttatttttcatttgcttcctggttggctttaaactcatccatggaaatgtaatgatcattgatggtctgtcccttatagcgaaggttagatacaccaaatggtgcatactgaccgtcaaatacattcagggtgtctgcaacatatctgctgacagtaatactgaaaggaataacaagagcatggttaataagacttgcctctgccttggcaaaagcctcataacgggaattaatatctgtcttaaggctcttagcttcctctaccagagtaaaatattccgaagctgcctctgcggaaggagttccctcttcaatggcctttgcaatatttccatacttatatcccagatcatatccttcttccccttttttctggtagaatgggtctgtccaggtttccgggtctgcataatcagcaccccagttgcacttcataaatgcaaacttgccgttgcggcgtacttctgttaagaatccgtctgcaggacctgcctcaacaataatgtcaatgtaatctgatccgagaagtgcttccatctgctgttctacgatctggcactctttatcccagttaagctcagaaggattataaggcatcagaacctttacagggaatgttgttccttctgcctccagctctgtctttgccaaatcccggtattcctttgcctttgtctcgtcaaaggtctgtcccagagatgccatatcacctactgtcgtaaaatcttcaccatctgcattaaaggtaaagttagccggtgtaatggaattgatagcaaaatcttcaggcgcattggcgtctgtaattgcaattgggtttaccttattcaacgctgcaaataaggacttacggaagttttcattatttacagcctttttccagttatccggctcatactgagcgtcaaactgaggattaaagttaaaactgtagaagtaagaatagctggttctcggtctttcccggctgattaagttcttggtatcctcaccatttaaccagtcatccagaatatctgcaggaatctctgcataatccacttctccccgctttaccatctcaggcccaatggtattatactctgcattgtagactctgtggatctcgtctatgtataccatatccgcatcataattcagaggattctttttcatgatctgtctttcctgcggagaaaactctgccagataatatgcaccattataatacatcttatcagcaccggttccgaactccttgccaagctcctcaagctgcgggccataagcaggcatatataccacataggcaagagaagaaaggaagtatggaacctcttcttccaaagtatagaccagtgtatgttcatcaactgccttcacacctacttcagagaaatcaataggctcccacacattgccgtcctcgtcagcaccgccattgtaaacaagaccgttataatacttttccgcattagcaataacaccgaaaaggttctgtacatttgcactttcatactcaggagtcagctcatatttcatagcatccacaaaatcctgggcagtcacgccagctgcctcagcacctgtatgatcaacccatttagcttccctcagagtaaaggtccaggtcagagcagcttcatcatgctcccattcggtagcaagccccggcttaatctgtcccttgttgtcatattcaatcagggtgtcgatggtatttgcaggcagccagtgatcattctgtgatgaggtaaccaggtaattcactgtggtagcctcagatccatacagtctggtataaactgtaggagctgcgcttcctccacctgcctcagtttcctttcctgcgccctgggaactgcctcccgtctttcctccgcatccgcttaaagccacggaagcagtaagaacagcacatagcatagaagcgattaatcttctcttcttcataaatactcctccattttcctaatattctaaacccatggggattagtatcgctcttaaaaccggcaaaaattaaaatcagtcaataaacacgggaactctggtaatacccattccagcctcttccccataagaatcctgggaccctcaaaaaccggacctcctgtatagggatcttccttacacagagatggaccatccaaatctgccctggtaataattccctttcctgccgccaaatgggccgcagcactgactgcaatcttgctctccaacatacatccaatcatgcactccacgccaaagctctccgcaatggcacagatctttaaggcttcataaatgccccctgtcttcataagcttaatattaatcagatccgctgctctttcccggataatctgtatggcatcctcaggagaaaaaacgctctcatctgccaggatgggagtatatacctgactggtcacaaatttcattccctcaaagtcatgggcatttaccggctgctccaccagatccatgtcaattcccatatcctccagcgttctgatgatcctgaccgcttcctttggggaccagccttggttggcatcaatgcgcagcttgatatccggtcccaccgcctggcgaatggccttgatccgctccacatccttccggctctctttccctaccttaattttcaggatgcgaaaaccttgggaagttgcccttaagctgtcactgaccatttcctcaacatcattgacgctgatggttaaatctgtttcaatctccctctgtccgcctcctaaaaccttgtacaaaggtttcttacaggactttgcaaaaaggtcgtaaacagccatatccacagctgcctttgcagaactgttctttaatatgcagccatgaagctttctcatgatccagtccagattctcgatctccatgccaataagggccggagccataaattcctcgatagcagtgatgatagaaccctgagtatcccctgtgatcaccgcagtaggaggcgcctcaccaaaccctgtctgaccgtcatccgttgtgatcctcaccacaatatcatttacgctgtcaaccgtcctaagggctgtcttaaacggtgtcacaagaggaatgctgacccttgctgtctctatctttacaatcttcatttactttccctctgtttcctaaattcctttattggtctccttgtacaaatccagagatacctcagccatgaccctctcaaaagccggagtatccgtctcatttccgcagaagcagaccaaaaaaggttcctttccataaacaattcctacatcatgagtaatgcccgtatcttctcctgtcttgtgagcgatctccggactttccgaaagagcctgcagataaaagggaatcttgctgcaaagctgctgattcttcaaaatggatatcattgttttactggactgccggtctatcagtaccccgttatacatcatttttaaaagcctgcctgtttcatgggcagttatgtaattctggatcccccggcctgacctttccatatcatacatttttctctgaagaagagtctgccggaacccaagtcctctgattatttcattgatctcctccattccaaggatatcaatcagaacatttgtcgccgtattgtcgctgaaaatgatcattaaagtgaccagatccattcccgtcaccagaattccatcatgaagataggtaagggcaccacaggaaggaacccggtcctcctttttcacggaaaacatttcatccatggaaaaagttccccttttttccttttcaaatgcggccgccatgacaaacagcttgataacgctggccgccatcatcggctcctgttggtgataggaaaatccatctcctgtctccaaattctcatataaaaaactgattttcccaggaagcctttccagcttctctattatttcatccttcataaatatgaataaactccctgccggccaaagttaacagccttatataaaaaaagaggcactgcacctattgtctacagctacctcatcgcacctgattctaacgccctaaaagccctaactttagtataataaattctgagaaaaaatcaagctataatttttacaaatacaatcttcccgtgaattttccgaaacagatataaaaaaagaacagttttttctattataataaaactgttcttctcatgcgccggacaagattcgaactcgcggccttctggtccgtagccagacgctctatccagctgagctaccggcgcattttttagtacatggttaatatacacccatttattcaatttgtaaagtagtgaattcattcgaaaagggatatgagaaatataatggaagtcttaaagaaaactgttttctatgtaaaaacagcaaaattgaaatcacagctgaattataataatgttacccttgggcataatatgaataatatatatcaggggcaaaacaaggaggggaatttatgaggagctatttgtctattggaattttttttgcaggaataattttagctgtatacatcggatattggaccttattcatcaaacctattatggtctgtgtttcggcagcagacgcaggggtgctgaccgccgcgatgacgacgatgacaatcattaaatgtgccttatcatggttggtcgcgggagtgatcttcggattggggtatattgctgccatgattgtaagtcacaggtaatccgggacgctgtattggaggtagaaaaaatgttgaaccaagaagtacaagcatggatagatttggggttttcacatgaagaagcaattactatgacaaatgtgataaatgccggaaatgatgatgttgaaataacagatgatgactcaattacttcttttaccgattcatctaagaagaatatgtcgcaaaatgatatatgatgccaatacacggggcattataatgcaaatgcgaccctgatacaatcctctgaatcaatgcacaacaaaaacaaaaaaggcacccttcacaggatgtcttaaactatgaaaacccttataaaataagggttttctgtacgtgcgtgagaagattcgaactcccgacaccttggtccgtagccaagtgctctatccagctgagctacacacacatattcacttgtttgccttatcaggcaaatgccggcgaccggaatcgaaccggtacgggaggtaagtcccgcaggattttaagtcctgtgcgtctgccagttccgccacgccggcattctcatgatttgcgcgggcaacgagccaagccaacatgcttgcatgttcagttgacggctgccgcgataacgagggaaattcgcaaaacgtatttcgtctcgttctcatggaaatgggacctatagggctcgaacctatgaccctctgcttgtaaggcagatgctctcccagctgagctaagatcccatatgcaatgtagtaagtattatacaacttacctgctggtttgtaaagcctgtactttttttgtacagaacgacccggatgggattcgaacccacgacctccgccgtgacagggcggcgctctaaccagctgagccaccgggccagattaatttagttcagtgttagtggaccttcggggactcgaacccaggaccgaccggttatgagccggttgctctaaccaactgagctaaaggtcctaaacattataatctgcaaatatattaaattgtctaaaagccgatgatcggactcgaaccgataacctgctgattacaaatcagctgctctgccaattgagccacatcggcattaaatgaccccaacgagattcgaactcgtgttaccgccgtgaaagggcgatgtcttaaccgcttgaccatggggccaaagctccccgagtaggacttgaacctacgacccaacggttaacagccgtttgctctaccgactgagctatcgaggattactgaggcatataccctcaaaaccacacattgttacatatctatcttcatccgttcttcttttcctcttacctaaaccaacctggttaagccctcgacctattagtgacagtcagctgcacatgttgccatgcttccacctctgccctatctacctcgtcgtcttcaaggggtcttactcttgcgatgggatatctcatcttgaggggggcttcacgcttagatgccttcagcgtttatcccttcccgacttggctactctgccatggtgttgatcaccaacagatacaccagaggtcagtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcaatcccactttataccaccggatcactaagtcctagtttcctacctgctccacccgtcggtgtcgcagtcaagctcccttatgcctttgcactcttcgaatggtttccgtccattctgagggaacctttgagcgcctccgataccctttcggaggcgaccgccccagtcaaactccccgcctgacattgtcccccagccaggtcatggctgcaggttagaaacccaataccgcaagggtggtatcccaacatcggctccgataagactggcgtcctatcttcactgcctcccacctatcctgtacatgcagtaccgaatcccagtatcaagctggagtaaagctccatggggtctttccgtcctggcgcaggtaaccagcatcttcactggtacttcaatttcaccgggtgcattgtcgagacagcgctcaaatcattacgcctttcgtgcgggtcggaacttacccgacaaggaatttcgctaccttaggaccgttatagttacggccgccgtttactggggcttaaattcagagcttcgcgttgccgctaacccctcctcgtaaccttccagcaccgggcaggcgtcagcccatatacctcacctttcggttttgcatagacctgtgtttttgctaaacagttgcttgagcctattctctgcggcctggtttccaggcaccccttatcccgaagttacggggtcattttgccgagttccttaacaatgcttctcccgccggccttaggattctctcctcatccacctgtgtcggtttacggtacgggcacatatcacacaatagcggcttttcttgacagcccctacgaagacttccctacttgtgttcggtacgcgtcacaccttcctgttgctgagcggattttccatctcagccagtaaaatgcttgccccggtcttttcattcccgggttcttcctcggttctgtgtccccacagttctgatgatatgcggtacaggaatttcaacctgttgtccatcgactacgtctttcgacctcgccttaggccccgacttacccagagcagatcagctttactctggaaaccttagatattcggcctggaggattctcacctccatctcgctactcattccggcattctctcttcttaacactccacatctccttacggtaatgcttctgtgcgttaagaatgctcctctaccaatgtgtatgaatacacattccacagcttcggtgtcgtgttttagccccggacattttcggcgcaggacctctcgactagtgagctattacgcactctttgaatgtgtggctgcttctaagccaacatcctagttgtctctgaaatcccacatccttttccacttaacacgcactttgggaccttagctggtggtctgggctctttcccttttgactgcccaacttatctcgtgcagtctgactcccgtacatcatctggccggcattcggagtttgatattctttggtaagctttgacgccccctaggaaattcagtgctctacctccggcagactaatacgaggctagccctaaagctatttcgaggagaaccagctatctccgggttcgattggaatttctcccctacccacacctcatcgccacccttttcaacggatgtgcgttcggtcctccatttccttttacggaaacttcaacctggacatgggtagatcacccggtttcgggtctacctttactgactcattcgccctattaagacttggtttcccttcggctccgcaccttaagtgcttaaccttgccagtaacggtaactcgccggaccgttctacaaaaagtacgcggttccacttaaaatgtggttccacagcttgtaaacacagggtttcaggttctctttcactcccctcccggggtccttttcacctttccttcacagtactatgcgctatcggtcactaagtagtatttagccttggggggtggtcccccgaattcccacaaggtttctcgtgtctcgtggtactttggatcctgctcgctgactattgctttcccatacaaggctttcactttctatggccgtctttccaggaccgttctggtaacaaatcgtctcacttattgcagtccgtaaccccggtatgcacgcataccggtttaggctctttccatttcgctcgccgctactttggaaatcgagttttctttcttttcctccgggtacttagatgtttcagttccccgggttcccgacgtatggctatggattcaccatacgacaactgaggtttgctcagctgggtttccccattcagatatctccggatcaaaggatatttgctcctccccgaagcttttcgcagcttatcacgtctttcatcggctcttagtgccaaggcatccaccctgcgctcttattagcttaaccaattcgatgttcacctgcgggtgcgggtgactcatctaagatacatagcgttgtatctctggtcttaggtttgttatttcaccgtacgttacggttactttaacgagttttgtttggttacatcttacgatgtaacacctcggatgtcttgattttgtttttatactttgacatataaaaactaatctagatatatttcaatatgtggttttcaaggtacatgcgcgatgcaatcagaagcgtgcacaatcatatggaaaactgtgttgaacacttgtgttcataagcagttttttatgtgattgtataggcgtggaacgccgtgactgagaaaagcgtcagcttttcgaagtgcaccttcgtaactacatcaaatggagatggagagattcgaactcttgaccccctgcttgcaaggcaggtgctctcccaactgagctacacccccataaataatctggcacccacctgctctcccatgccgtctccagcatagtaccatcggccgcttaagtcttaaccatcgtgttcgggatgggaacgggtgtctcccctaagcgcatcggcaccagaaattttacgtctttcttagtgtttccttattattcttttttacttcttttgaaaaccaaagactcaacagtatataaaacccttacttcttcttccttagaaaggaggtgatccagccgcaccttccgatacggctaccttgttacgacttcaccccagttatcagtcccgccttcggcagctccctccttgcggttgggtcactgacttcgggcgttaccaactcccatggtgtgacgggcggtgtgtacaagacccgggaacgtattcaccgcggcattctgatccgcgattactagcgattccagcttcatgtagtcgagttgcagactacaatccgaactgagacgttatttttggggtttgctccagatcactcctttgcttccctttgtttacgccattgtagcacgtgtgtagcccaaatcataaggggcatgatgatttgacgtcatccccaccttcctccaggttatccctggcagtctccccagagtgcccaacttgacttgctggctactaaggataagggttgcgctcgttgcgggacttaacccaacatctcacgacacgagctgacgacaaccatgcaccacctgtctggaatgccccgaagggaaggccccgttacggaccggtcattccgatgtcaagacttggtaaggttcttcgcgttgcttcgaattaaaccacatgctccaccgcttgtgcgggtccccgtcaattcctttgagtttcattcttgcgaacgtactccccaggtggaatacttattgcgttagcggcggcaccgaagagctttgctccccaacacctagtattcatcgtttacggcgtggactaccagggtatctaatcctgtttgctccccacgctttcgagcctcaacgtcagttacagtccagtaagccgccttcgccactggtgttcctcctaatatctacgcatttcaccgctacactaggaattccacttacctctcctgcactctagcaacacagtttccaaagcagtcccggggttgagccccgggctttcactccagacttgcatcgccgtctacgctccctttacacccagtaaatccggataacgcttgccccctacgtattaccgcggctgctggcacgtagttagccggggcttcttagtcaggtaccgtcattttcttccctgctgatagagctttacatgccgaaacacttcttcactcacgcggcgtcgctggatcagggtttcccccattgtccaatattccccactgctgcctcccgtaggagtttgggccgtgtctcagtcccaatgtggccggtcaccctctcaggtcggctactgatcgtcggcttggtgggccgttacctcaccaactacctaatcagacgcgggtccatctcataccaccggagtttttcacaccgtaccatgcggcactgtgtgcttatgcggtattagcagtcgtttccaactgttatccccctgtatgaggcaggttacccacgcgttactcacccgtccgccgctcagtcagtttaaaattcatccgaaaacttcatttaaaccgcttcgctcgacttgcatgtgttaagcacgccgccagcgttcatcctgagccaggatcgaactctcaaatttaagcagatagtctttgaaagcggtcggtgatttgcacaaaagcccgttggaagtttacttccataagggatttgggggaaatcaacgaacatttgcgaagcaaatggtagcgaatgaagcaaagcttcatgagcgtaccgcttagacctgccattcggttcaatccggggtcaaaatcaactaactagctaatttttttcccgttttacttgttgtttggttcgtatacaattacttgtattcgttctgaattttctcattcaaagccatcaaacaatggcttgttttattagaattttcagggttttacatactgttcaatcttctgttttcaaagtgctgtttgcatctgccggaaactttcattccccagatgctgacgcagaaggagggatttgaaccctcgcgccgctactaacggcctactccctttccaggggagccccttcagccgcttgggtacttctgcaattagctgatttttctatgttattagcggctaaaaacctgccaacggagagggtgggattcgaacccacgcgcccttgcggacaaacggttttcaagaccgcctcgttatgaccacttcgatacctctccaaatgtgcttttatattctaatagaagtccatgcttttgtcaagcacttttttctatttttccaaatctcttggaggccgatactgcttgttttgctgcacttatcagctgcaacttggatagtttatcattgtttgtatattctgtcaacacatttttacatttttttcaaattatattttaaagccctataaatgctttaaaagccattgttttgcttcctcagctgttttaaaatcttcttctgtcccagtcatataacaggccgcatcttcccatacttttaccggataatccgatgccggtattgcagaaacaacaaagcggcagcatctttttgaaatacagtttcttaaatctgacaggtacatgcagcccgactctgctgctatccggtccaaaagcccagccttggcgtttttgtccttccctatcctgtttgcttcagttttcatctactgtaccttctttcatctttcccgcccatgcttttgggcagagtccgccccgctttaccgggcgtaaaggtatacccgcaggatgcttcctctgatgcagcctcgacaagatctgacagccacccagcccgcatggcggacttttctgtataatcatacattaaatactttatataactaataatattgtaatgaatgcaacatgtcaagtgatggattgcattatttactacatatatttcatttaatgcaatactatggaatcaggaggagctacctatgtatatagatttcaatttttcaaaacgtctttccgagcttagagcccaaaaaggcgtatctgcacgcgatatgagtctgtctcttgggcagaatcccacatatatcaataaaatagaaaatggactagctcttccgtccatgatgggattcttttatatatgcgagtatctggacattgaaccagccgaatttttctcccatggcatcagcagcccggcaaaagtaagagagctgatggaggatgcccagcatttaaacagagagcagcttgagcaccttcatttaatcgtaaaggatcttttgaaatcaggaggaaaaaaataaaaaggaagctgcgcttacagcattccttttatttttcccaatgatttctttttatcagcaccccggcaatttccatgtcttccggtgttgtaatctttatgttggcataatcgccccgaattaatttcaccttttcctgtgtcatggtttccaccaccatggcatcatccgttactacctcttgatattcttccgatgacataagcttttcataagcttgaagcaccagcccatattcaaaggcctgaggagtttgaatcagccataaacggtttctgtccggtgtcacggaagcaaattcattttcatcggaaactttaatggtatccttaacgggcattccgaccgcacaggctctgtacattctggctccattggaagctgcctctatgacctcttcggtgacgcagggtctggctccgtcatggatcagcacatagtcacagtttttaactgctttaaggccctggtatacggaatgataccgttcctttccccctctgtaaccgcagtcacctttctgaaaccgtatttctctatgatctcctcccggcaatacccggcttctccgggtccggtcaccaggatgatttcatctatcgaactgctttcaaaagcatgaagtgcgtaatacagcagaggtttcccaaagagttccaagtactgcttatgcacctggcttcccatgcgtgttccttttcctgccgccaatatgactgctgctgttcttcccctgctttctatccgattgctttctctttcctgtccatgctttttagacataaaggcatcctcccggcatattacctctcccccagtttcaagttggggaccgcgtttaaatcccaaccggctctcgctccattgatatactcataataagctgcagtgccgatcatggccgcattatcggtgcagtaaacgggtgacggatagtatagggaaattccggcttttttacaggcaaggttcatcccttcccgcagggcagagttagaagccacgcctccggctatggcaacctttttaaatccatattcttttgccgcatctgccgtatgactcaccagtacgtctacaaccgcattctggaaggaggcagccaaatcagccacattgatttcttctcccatcatgttggcgtggttgatgtagtttaatacagctgacttcaaaccgctgaagctgaagtcataaatgcttccctccacctttgcacgggggaatttaatggcatggggatttccttccctggctgccagatcaattttcggacctcccggatatccaaggccaaccgctcttgccaccttgtcaaaggcctctcctgccgcatcatccctggtacggcccagaatttcaaattctccgtaatcctttacaaccacaagatgggtatggccgccggatacgatcaggcataaaaacggcggctccaggtccggatgctcaataaagttggctgatacatgtccttctatatgatgcactcccaccagcggtttacctgcagcataagcaatggcctttgcctcagcaacgcctacaaggagagctcccaccaggcccggaccgtaagtgacgcctatggcgtccatatcctccaggcgcagccctgcttctaaaagagctgcttctatgacctgattcattttttcaatatgctttctggatgcgatttccggcacaacgcctccgtataaagtatgaagggcgatttgggaagagatcacattggaaaggacctctcttccgttttttactacagctgccgccgtctcatcacaggaactttcaattgcaagtatatagacatcttcctctgtatggttctttttcattgcctctccctcactcctcatcaaattccagctctaaggtccaggcatcctttgccgctttggcgcggggaaagatttcccggactttctccatatattcctctggcctggtaagggaggggctgtaatgggtcagccacatctgcctgggctgggcttcctttgccagcctggcagcttcataaaaggtcatatgcttatattctcttgctttcgtttcctttccgtcctcaccgtacatgccctcgcagataaaaagatccgcctcctttgcatattccgcaatcacaggaaccggtcttgtatccgtacaataggtgaccttaagcccccgtctttccggccctaagaccatgtcaggagttaaagacctgtctccgtctacaatggtttctcctttttgcaggcggctccagaatttctggggtattccggcggcattggcccggtccacatcaaaccggcccttcctggggatggaaatggagtaaccataacaaaccacgttatggttcacccggtaagcatcgatcacataaggcccgatttttacctgctccctgttttcggaaagctcgataaatttcaaatcaaagggcagctccggcgcaatggtccgcagggctcccaccacacgctccaggccctttggcccgataagtgtcaggggttctgtcctttccgcatttcccatggtcaggagaagccccggaagaccgctgatatgatcggcgtgataatgggtaaagcaaatgatgtcaatgggcttcgggctccagcccttttcctttagcgctatctgggttccttctccgcaatcgatgagaagatcactgccttcacatctggccatcatggctgtcagccatcggtacggcaacggcatcattcctccggttcccagcaaacatatatccaacataaaatttcctctcttctgcccatgctttccgggcatcgaggtataccaaaaggatgtttcctctcttctgcccatgctttcctggcagggcccgtcccgctttatggggcgtcgaggtctatccgaagggtgtttcctcgctttggtttcgatcaatgaatgacggtcaaaaaaccgcctcataaaatcatatcacaaagcagaggcaattagcaactataaatattccagctgttcttctacctccactggaatcttgaattcctggatgatggcatcgtaacagtcctcacacagatcaaaatgatggatctccccatctttctcggagaaaaagtcccaggtatgattgatattgattaccccctccctggaaacaccttctgacacgataatttttttgccacagcagttgcacacaactgtttcaagctgaccaccgtttttgtactttctcatcttcctctcacctttcctttttcgcacttaccagttaagccctgtttccgctttgcataatctgaaaataggaaaaagggcatccttactggatacccctacattataaacggagtttccccctatttttagtggtaaatgtttcatatccggcggttccacatgatgactgcattttcctcaggatcacggtaataatttttccggatggtctcctctttaaaaccataggatctataaaggtttctggcttttttattgctttcacggacctctaaagacaaggattttgcttccttttctctggaatattccaccagctggtccataagtttcttagataatccctccccctgtattcaggaagaacggcgatccgaagcagttccccttccccggcaatgatccggaagacgcagtacccaagcaggtccccccctcttcctgtaccagccaggtatcaaggctgctttccaaaccttccttgatggattccaaggaccatggatcggaaaaacagatccgttctatttcatagactccaaacacatcctccggccgcatttcatgaaccatgggcttctcctcctttcatggaagttcaattcaccttatggcttagaacggctatgcctcccgctcccgttctgcctggggctttcttaaataaacaggggcgtgttcttccgccgtaagggtcttcccctcctcgtaatacttacaacccaaggccgccactgccgctgcccgctgccggtttaaatgagccggagcaaacaggaagggaactgtcatcttttcttgtatttgttttttgtatacagggacgccgtctcctaagaacatcactttctgtccggctgcatttaattcttccaccagttcttcaatgtccatggcgcattgttcctttattatggaaaaaccgttccggttatcataaatgccggtatatacctgattccttctggcatccataatggggcagaccctgtaggcactgccgtataggttataggccatggcatctacggtgggcacggaaatcagaggcttctttaaagcaaggccaagtccctttcccgtggcagaaccgatccgcaggccggtaaaggaacccggccccccggaaactgcgattccatcaatggtctctaaatccagttccaccatttttacaatttcatccagcatgggaagaagggtctgggaatgggtcctcttaaaattcactgtatattccgcagttgttacctcgtcctccacaatggcaacggaagccactaaagacgagctttcaattccaagtatcctcatttacattccctccacggttattttcctgtaatcaaagcctttttccatgtccttttctatggttacggttattacatggtcaggaagaagctccttaatcaggttggaccattcaataaggctcactccttctccataaaggcaatcctcataaccgatctcatccatctcgctgacatcaccgatgcggtatacgtcaaaatggtaaaaaggcagacgtccctcctcatactgattgacaatggtaaacgtagggctgtttaccggctcctcaatcccaagtcctgatgcgaacccctgggtaaatacggtttttcccactcccaaatccccatttaagcagtacacagaggaaggcctggcttcctctcccattttttttcccagttcataggtttcttctggcttccagctttctattaccatcatttatatcctctttcgcctttcaggaggcagtttttctttaataagactacggatctccgtctttttctctcccaaaacggaatcaggcagcagataggcatggactctgtccatatacaggatcatcatatctcctgcacggtccacctttcctatgttctcccaggcaatgggaaggctttcctctccctgggaaaccagaattccttcctcatcaaaggtaaggagcatggaattctggatcctggggttctttgcctgcctggctgcctttagataaagaatgcccggctgccagaccgtaaacatcagggcgcagacgatcagcagcacccggtacggggtagaattggaactccatgtggtgataagtaggaaaacagcagcagcgctgaaaataatattaaaaagcccctgcagcccctgataggaatgatacatagaaaacttccacagatcctttgcagtcaattttacttctatctcaatcggatgtttctcttccactcttttctccttcctgtgctttggcacagcaattcctgacataatctttttaatgaaggcaggggaattcagtttccatttatagcttcatggtcagtgcgatcctctttttctgtgcgtccacacttatgaccttgacctcaacaatgtcccccacactgacagcttctaagggatgtttgataaatttatccgacatctgggaaatgtggacaaggccatcctgatgtacgccgatatccacgaaagcgccgaaatcaatgacatttctcacggttccctttaaaaccatgcctggttttaaatccttcatctccatgacatcggtgcggagaatgggtgccggcatctggtccctggggtctcttgccggtttttccagttcctttacaatatcccgcagggtaatctcaccgatttccagctgagctgccagagacttataatccaggatttttttgccgattccgcttaagcctccccgggccagttctttcagatcatagtccagcttttccaacagcttttttgctgcctcataagtctcaggatgtacgctggttccgtccaaaggattctttcctccctggatcctcataaagccggcacactgttcgtaggcctttggccccagcttcggaactttacgaagctggctcctgctggcaaatgctccgttttcttcccggtaaaccacgatgttctttgcaatgggttttgaaatgccggatatatattccagcagggaagcggaagccgtatttaggtccacgcccactttgttcacgcagtcttccacaacgccctgaagggcctcgcttaaatgcttttgattcatgtcatgctggtactggccaactccaatggatttcggatcgattttaaccagctctgctaagggatcctgcagtcttcttgcaatggaggctgcactcctctggccaacgtcaaaattaggaaattcctctgtggcaagcttgctggcggaatatacagaagcccctgcctcgtttacgatgatatactgaaccggttccggtgtttcctttagcaaatccacgatcactgcctccgattccctggatgcggttccattcccaacggaaatcagggaaacgtggtattttttgatcagcttctttaaaacggcctttgcttcctccaccttgttctgaggagccgtgggatagatgaccacggtatcaaggacttttccggtctcatccacaacagccagcttgcagccggtccgaaatgccggatcccagcccaggactacccgcccggcaatgggggctgcatcaaaagctgttctaagttcttaccgaacacccggatcgctccatcctctgcctgctccgtcaaagagcttctcacctcccgctcaatggcaggggcgatcagacggtcatagctgtccacgatcacctcttttaagacaggagtggtgtatgggttgtctcttacaattacctgcttttccagaaaacgaagaatctgttccacgggagcgagtatttttaccgtgagaatcttctctttttctccacggtttaatgccagtatcctgtggcctgcggattttttaatggtttcctcgtagttataatacatttcatatacggattccgcttcttcatcctttgccgttccctgaagacttccctggttcatggtagcattcctgatgtaggtgcggtattccgcattgtcggaaatccgttctgccaggatgtcctttgctccgcttatagcctcttccggggaagaaacgcctttttcttcggaaaggtactggtccgcggcctctgttaagggagtcttaatcatctgaagcatgatcagatccgcaagaggctccagccccttttcctttgcaatggtggcccttgtccttcttttaggtttatagggacggtataaatcctctacagcaaccagggtctgggcttccaatatctttttttccagctcaggagtcagcttctcctgctccctgatggaggaaaggacctgctccttccgctcttctaaattccgcagatagcggagccgctcatctaagtttcgcagaacctcatcatttaaggagcccgtaacctccttccggtatcttgcgataaacgggatggtgttcccttcatcaatgagcttaactgctgcttccacctgtccgcgggtaatggaaagttcttcttgtaatgcctttattatatccatggcgatccccttgtttttcaaaatttatatactggtgacacaaaaagatatgtctgcatacccttcaacctttccattctgatgaatcaagggatccgagtgcatatccggctgatgcccggtgaagcagggcacgctgttcaaacgggagctgaaagacattttcttccagtcttcattcaacttactattataattcatcaaccggtctaatgcaagacctgtctggacacgggggacttttcatgctacaatcatacaatagtataacttatcgaaagtgcttttgcttccgataatatggtatatgaaaacgaggtaaatcacgaatggaagaaaatcataacagcaacaacggtatgctgccccagatccgtcccacaggttcttttctggccttctggtccgttcttctgggcggtattggactggccagcgactgcatccccttattcagcatctggagtctgccggccggtctttttctcggcctgatgggcatcgcatgcgcagtgctttccagacagggaaaaccctttacccagcaggcccagctcggtctgatcctgtctgttatttccacagtctgcggacttatgatggcattgttcattatttttgtatatgataccatggacaccaacacacctttgggccactacttcagacaggtttttgaaactgcctcccaggcccttacagccacctctccttctggagaatagggactacctcaaaagaggaagcaggtccacacctttaaagaccagcatataattcttgaaaatccaattggccgccacgatcgcggcccctgccaggataaatatcctgtctgcttttcttatatccacggaagacttttgccttttaacggcagcccttaggatcatttccaaaaacagtacaaaaacagcataaaggaccaacggatgatactgaaaactcatccgtaagtccccctttaacaatgaccggatggcccgggtcccgccgcagcccgggcaataaagtccggtcagggtttgaaacaggcagggaagccccaggccaaataatttttttaaccagttcattttttgcagcctctaatccgccagatcaaaggcatcatggaccgtcctcatagcacggtttacatctgcttcatcgatcaaaactgttatcctgatctcagaggtggcgatcatcttaatgtttacgttagcgcttgatagggcctcgaacatctttgcagccactcccggattgcctgtcatacctgcaccgatgatggaaatcttggctacgccttcctcgcttgtcacatcctgagcggtaatggattccttattttcccttaaaagatccatggtttcctttaaatcggtctttgctaccgtaaaggaaatgtcttttcgctcttcccgcccaatggactgaatgatgatgtccacgttaatattgttctttgccaggagattaaagatcttaaaagcaattccaggcgtatttttgaccccgattactgaaatacgggctacattcttatctgcggccacgccgctaaccagcattctttccaattttgtttcctccttgacaactgtaccttctgctctggtcaggcttgacagaacaaccaactgaactccatagcgctttgccatctccacagaccggttatgaagcacctttgctcccagggaagcaaattccagcatttcatcataagaaacctccggaagctttctggcatttggaacaatgtgggggtctgctgtgtatacaccatccacatcagtatagatctcacatgagtccgcatggagggcagcggccagggctactgcagtcgtatcggagccccctctgccaagtgttgttaagtcatcgtatttattgattccctgaaagcctgtgatgatcacgatctttctggcctccagctcatgccgtatgcgttccgtatcgatcctctttaattttgccatcccataagcagaggtggtgtgcatggccacctgggacgcatttaaagaaacggccggaacccccaaagaattcattgccatagccataagtgccacgctgacctgttctcctgtggctaagagcatatccatttccctctttggagggtttggattcatctcataggcttttgcaatgagaccatccgtagtctttcccatagcggacaggaccactactacctgattgcctttttcatattcctcaatgcagcgctttgccacattaaaaattctttccttgtctgcgacggagctaccgccaaatttttcactactaacattgatgcctcctggcgaaaagtcaagcggatattcccatccgctttgctgtatgctcataaactgttacaccttgtaaagcggagattccagctccgcttcacgccttatcagcggggcattcagccccccgctgatacaagcaagccaccatgcccgctgtttcgttctccacaaaccggaagcaggggattacttgtttgcaattctgcgcggatgcgctgcctgatccctgacagctttttcgctttttcttcatattcttcttcagtcatgacttcagtaaggaccgcaaattcatccatatggtccagttccaccacttccacctttccgaatacttcctccacttctttcatgcgcttttcagcgatccccttgattcttacaaaatagcggaaggagaagctgtctatggctgaaatggcaaggctttccctgtcccagcccatttccacatgacggccattgtctttcagggcttcaataatatccgcggccacagcgctggctgtgggaagctttcctgctccgcttccgtagaacatggaagtgcctaacatatttccttttacaagaatgccgttatatacgtcatttaccgaatataaggggtgatcctttccgatcatgaccggggctacaaatgcatgggcaatcccttcccggattctgcttgaaccaaacagcttcacagaggttcccattgcatcggcatagcggaaatccacatccgttatttttgtaatcccttctgtataaatatgctcgtaattgacctcgtgtcccgttgccacggctgtcagaatggcaatctttcgacaggtgtcgtgtccttccacatcggcttccgggtttctttccgcataaccaagctcctgagcctttcttaaggccgcttcaaaggtctctcccgctttgtccatttttgtcaatatatagtttgtggttccatttaaaattccggtgatctcttcaatctcctccccggcaagggaggtgtaaagagggcgtatgatgggaatgcctccgcctacgctggcctcgaaaaagaagttcacgttatgttctctggcaatctctaaaagctcggtgccgtatgcagccaccagggccttgttggaggttgccacatgttttcctgcctctaagcttgcctttacaaagggataagcgggatttaatcctcccatagtctcgatcaccatggacacttcagaatccttctcaatgacggaaaagtcatgaacaattcttttttccattggatcccccgggaattcccttaaatccagaacatacttcacttctaccttgtcgccgacccttttggcaatcatctccctgtttctttccaaaacctctgccacgcctgatccaatggtaccatagcccataattgcaatatttttcatatctctctactccctggctaaaattttaacgtagtggaccccatttttttcttccatatcctccaccatttttgaaacattgccggttgtctcaaggacttccacgcttaatgtcaaggtggccaccccattgaccggaatgctctggtgtatggtaaggatattggctcggtacacagctaccacatgaagcaggtcggacagtaagcccggttcatcatccatctgcatcacaagagtaatggtttttccctttgtattatcataaaaaggaaagatatcatccttatacttataaaaagagctgcggctgatccccacccggtcagtcgcctcctgaacagtgatgacgcgctccgattccaacagcttttttgcctcaactactttcagcaatacttcaggtacagccttctgctttaccacaaaatatttacttttttcttccataataaaaatatcttcccttctgtgtccgcaaccgaaatacatctgtgctcatagggaagatattatcatatttatgcagggtatgcaactatttttctatttattttctttggttcttaaaaaaatacagggaaagacttctattcctcactgctgtctccggcctttgctcctgtgctcagccagcgtaaataggcgtacatgaactgatccagggaaccgtccagaacgcttccaacattgcctgtttccgcattggtcctgtgatccttgaccatggtataaggctgaaggacataggaacggatctggttcccccagccgatctccgtcatatccccacggataccggagagtttctccgcattttcctgctgctttaacagataaagctttgcctttaacatctgcatggctttatccttgttctggaactgggaacgctcattctgacactggaccacaattccagtaggaaggtgggtgatgcggattgctgaggaggtcttgttgatatgctgcccgcctgcaccgctggaacggtaggtatcaatgcgaaggtcctcgtcgttgatctccacatcaaggtcctcttcaatatccggcataacatcacaggatacaaaggaggtctggcgtttgcctgcagcattaaacggagagatgcgcaccagacggtgaacgcctttttccgactttaaatacccataggcattggtcccgttgatctgcactgtgacggacttgatgcccgcttcttccccgtcaaggtaatccaggacctccaaagaaaagcctttcttctctgcccagcggcagaacatgcggtacagcatgccgcaccagtcacaggactcggttccgcctgcgcctgcgttaagccttaatatggcgttgtcactgtcatactctccggacaaaagggtgttgatgcgcatggattccagtttttccttgaattcccttaacatctcttccacttccggaatcacggaaggatcattctcctcattacccatttcgatcatcacgccgatgtcttcaaacttcgtctctaaatccttataactctggaccgtatcctttaaattctttgcaaattgtacgatcttggccgacttttcaggatcctcccaaaagcccggctcttccatggacttatccagctcatcgatcctctttaacttattatctaagtcaaagtgaatccctcacttccactaatggtttttcaaaggttgataattcgtatttgtactggtctaactctaccactgtgtcacctgctttctgtttttaatttataaatacaaaattggagtccggcccttaaaagggatgcgaactccaattttataaaaatactatactaatttacgtccgcagcactgcttatatttcttaccagaaccgcatggacacggatcattggggtaaaccttggcctccacctttttcaccggcgcttttgcagcactgtcgtccttattggttcctgtcaccttggcagccggttctctttccaccttctgctccacgcggatgtggaacaggatccttacggtatcctccctgattgccgccgtcatttcatcaaacatctgatatccgctcatcttgtattccaccagcggatctctctgtccgtaagcctgcaggccgatgccctgacgcagctggtccatgtcatcaatatgggacatccatttattatcaatcacctttaagagaatcacccgctcgatttcacggatctgttctccctccgggaactcagcttcctttgattcataaagcttaatggcttcttccttcagcatgtgcttcagctcattcttcctgatcttcttatcctcaggaagagtgaccggatttaaaggaatgatgggaaggagaagggtgttaagctcgtttaaatcccaatcttccggtgcctggtcctcactgatggaaaggtccaccgcattttctacgatgtcggtcaccatctttaagacaacatcccgcatattgtctccgtccagaacctttcttctctccgcataaatcacttcacgctgttcgttcatgacctcgtcgtatttgagaaggttctcacggatgccgtagttgtttgtctcgatcttcatctgagccttttcaatggcgtttgaaagcatcttgtgctcgatctgctctccttccggtacaccaagggcattgaacatacctaccagtcgttcggaaccaaacagacgcattaagtcatcttcaagggaaatataaaatctggattcacccggatctccctgacgtccggaacggccgcgcagctggttatcaatacggcgtgactcatgacgctcagtaccgatgatctttaaaccgcctgctgcctttgactcatcgtcaagcttaatatccgtaccacggccggccatgttggttgcaatggtcacggccttgtgcacacctgcatcagccacgatctcagcttccagctcatgatattttgcattcagcaccttatggggaatgccccggcgccgtaacatgttgcttaacatttcagaggtctcaatggtaatggtacctaccaggacaggctgtcccttctcataagccatttccacctcattacaaacggcttcaaatttttctttctttgttttataaaccgcatcctcctgatccaaacgggctacaggacggttggttggaatggaaatggcatccattccgtaggtgttgcggaattctttttcctctgtaagagcggtaccggtcataccggcctttttgttgtacttattaaagaagttctggaaggtgatggttgcaagagttttgctctctctgcgaacattcacgtgttcctttgcttcgatggcctgatggagtccgtcggaataacgtcttccgggcataatacgtcccgtaaattcatcaacgatcaggacctcgtcatcctttaccacataatccttatcccggaacatgagataattggcgcgaagggccagaatgatgttatgctggatctctaggttctggggatcggataagttctcaatatggaagaactgctctaccttttccacaccctgttcggtcaggttcacgaccttgtccttttcatccacaacgaagtcgccggtttccgtgatctcttctcccatgatggctgccatcttggaaaactcgccggaggcttctcccctctcaagctgacgggccagaatgtcgcagacctcatacagctttgtggattttccgctctgtccggaaataataagaggcgttctagcctcatcaatcaataccgagtccacctcatcaataatacaaaagtctaaatttcttaaaaccatctgttccttatagatggccatgttatctctcagataatcgaaaccaagttcattgttggtcacataggtaatgtcacattcatatgcggtacgtctttcatcagaattcatggagttaagcaccacaccaacggtcaagcccagaaattcatggactcttcccatccactccgcatctcgttttgccaggtaatcgttgactgttacgatctgcactccgtcaccagctaaagcatttaagtaagcagggcaggtggataccagagtcttaccttcaccagtcttcatttcagcaatacgtccctggtgaagaacgattcctccgatcagctgtacacggaaatgttccatattaagaactcttcgtgcggcctcccttaccgttgcaaaagcttccggtaaaatgtcgtcaagagtttcgcccgcagcaagcctttctttaaaaagctttgtattgtttctcagttcttcatccgtaagtgctaccatggttggacgaagagattctattttatccacaatgggctctattatttttaattctctttcactatgagttccaaatattttttgaacgaggttcatgattcattctcctaatcttttaacgatctacacgatacaatctcgtatattgtagcactaactcctctttaattcaacgaattcataaaaaattaacattctggtaataatccggctctattattcccaggtctttccttttttccccagcaaacaacggcaaaactggaaaaaattatgtcgatctgacagattgcacaaaaaacttgttcgattctccggttttccacattatccacatcccattgtgtatttttcccccagttttatccccacgatgaaatcccataattagggagaaaaacagttatacaccaagttatccacattatccacattttttctccacatattcccatatttcccatcctaccatcagacgttccgctttttgtatatatgtcataaactttcctttttcgacgaaaagttccctttttcccttgacttttttacaagtgcatctatagtttttcaataaacttggaaaaatataagtagatacattttacaataaattatcgattattatcttataattttacaatgtaattgaactgttctaaataatgtgctatactataaccatctcaagaaaaaggagctgatgacttatgcgttttacaattacagggagaaatattgaggttacaccgggattacgcgaggcagtcgaggacaagcttggaaagctggaccgtttcttcgctcctgcgacagaagcaacagtaagactcagcgtgcagaaagaaatgcagaaaatcgaagtgactattccagtgaaaggacatataatcagagctgaagaatccagtacagacatgtacgtttccattgatctcgtggaagagatcctggaacgccagttgaaaaaatataagaataaattgatcgacaaaaagctgaatgctccttccttttccaaagcctttttagaagaagagaccctgaccgacgatcatgtggaaatcgttaagtcaaagaagttcgcagtaaagcccatggatccggaagaggcttgtatccagatggaacttcttggccacaacttctacgtattcttaaatgcggatacagaagaagtcaatgtggtttataagagaaaaggcggctcctacggccttattgaaccagaattctaaaacatgaaaaaaagcagccaggacatttgtccggctgcttttttgtttgcttaaatcctggttaaataccgctccacgctggtgattgcatttgcgccgtcggatactgctgtggaaacctggcgaagctgcttggtacgcacatctccggctgcgaaaattcctggaacattggtttcacagtcttcctctgccttgatataaccatggtccatttccaccaggttattaaaggcttcgctttgaggattgattcccaccgcaatgaacactccgtcaaccgcaagctttttcatttcctcggttttggcattctttatggtcagggattccacctggtctccgccttcgatctcctctaccacggtatcccagatgatttccacatttttctgattaaacagctgggtctgcagggtctttgctcccctcagcttattcctcctatgaattaagtatacctttttgcacattctggccaggaaaatcgcatcctcaatggcaacatcaccgccgcctaccacggctgccaccttattgcggaaaaatgcgccgtcacaggtagcacagtaggaaactcccataccggtaagctcctcttctccgatcacactcagcttccggtgctgtgctcccgtagcaatgatgaccgtttttgttgcgtaggtcttctcttctcctaccacggtaaattctccgtcgcctgcttcgatccgaagcacttcatctgtagaaaattccgctcccagcttttctgcatgttcccggaatttcatgccaagatcatagccgttgattcccggcagccccgggtaattatccacttcataggtattaaggacctgcccgccgctggcgatctccttttcgatcactaccattttaagttcagcccttttaccataaaccgcggccgaaagccctgcgggcccggacccgatgatcacgacatcataaatctcattcatatttatctacctgctttctatattctatctgatattaagttttcttccttcattatatctcaccagcccttaagtatgcaatgcctggttcgtaacaaaatcacaaaattataaaccccctctgtccggccacgttgcattctgtctgatgatttgataaaataagggtatcataaactgacagaaagggtgattttatggctagaaaaacagtactcataaccggagcttcccgggggatcggaaaagccgttgcagttaagtttgcaaaaaaaggatataacgtggtcatcaactgcctccacagcgaggaccgccttttgcaggtaaaaaaggagctggaagcctatcaggtatcttgtctttcctgcataggggacatgggggacacggaccagtgccaggcactctttgaacaggtgcgcaggcagttcggaacactggatgtcctagtcaacaacgcaggcatttcctacatcggccttttacaggatatgagcacggatgcctgggaccggattatccgcaccaacttaacctcagtattcaactgctgcaagctggccattcccggaatggtggaaaaaaagcaaggaaagatcattaatatctcttctgtatggggaatatccggcgcctcctgtgaagtcgcttactcagccacaaaaggcggcatcaacgcctttacaaaggccttggccaaggaactggctccaagcaatatccaggtcaacgccgttgcctgcggtgccattgatacggaaatgaaccagtttctcgaagaggatgaattaatcgctctcatcgatgagatccctgccggacgtctgggaaaagcggaggaagtagccgacctggtttaccacctgggctataaaaactcctatctgaccgggcaggtcatcggccttgacggaggctggatttaaaaaacaacaccccttaataaatcatatgttgaaaaccccatggtgtatactgactccggaagacaggccggagggggattcggagcgaagtatttttgatttatagaaggtgattcatcaagaagtccttatcagtattcaggcactgataaggacttctaatatattcatgattctcttatggatcatttcttcttgcacaattgccctgcttccggatattcattgcaaagcagccggtacggcggctcatcttcttctatttccggaaaccttcctactgcagcatccgcaaaccggttgtcgttgtcatcatcattgcacatggagacctctcccagcagtacgcttccgcctctatccggtaccgcaaaatcgtggtacatgcagggagtaatggttatgctttctcccggagataattttacctttgttccggcagatacgatgcttaacttcccatccatgcggacagtcacatccgtatccagaatccttccatcttctgaaccgttatacacagtgatatatacatcattcccgcctctgttaattatatcttccatcttactccagtgaaaatgcatggcaactgtttgcccttcatagagcatcagcagtttctctgcataggtttttttatattgatccatgtttaaattgccattgcggatggtgagcagggaaaaaccgacctggctgaattttcccagaccaaagtccgtaatatcccagcccagcttattatccctgatttcatcatattcatatcccttatctgaccattcccttgcagtccattttgcaaaaggggaatttcaaatttatgctccctgataagctgttccatatcttttattaccgtattaatttctgaccgtttcatcagaccgctcctttcctgtgcagcgccagactctcccgggtcaaagcgggtcaatacttatattcagataaaatgacctcaggcttatctgcgtccgtttcctcaatttttttccagtttgtcagcaattccagcaatgcgtcgattaatgccgtttcttttaagtgagcgtaatttttataataatcaaaggattcctttcttccatttgagatcaatacgtaatcagctaactccgataccggtgactgcctgtatccggtaatggccattatcttaaggcctttttccctggctaattccataccttgtataatctgtctggaacttcccgattgggaaattgctataataatatcatctttatcagcaagatttacatgattcaaaaaatattccggcgagatgccataggtgcatttcactcccagtcttcctaatctgaaacccatataaagtgccagaggcattgtatttcctactgctaaaacatgagcctgcttgcattcctttatcaaattcacacaggaccgcatatcttcttcatcaatgcattctgctatggctgttaatgaattcacatacttttggaaaattttcatgacaggattgggtgtgttctgcagctcttcaatttcttctccctcatctcttcccacatcctttgccagcatcagccggaactgataatatcctttatatcccagatgatggcacatgcgcacaaccgttgcatcactcacgccgctggcctttgccaattcagaaacatttgcatccaccgcttcctgtggatgttccaaaacaaaatccgctactttcttctccgctgagaatatctttccataattatccttgatcacttccaatacgggtttatctaacatcatgtccctccttcataccttattatattgccgtaaatcccgccctttttcaagctttttattcaaaacacatctgtacgccggcaacaaaggaatcccctaatccaatggtatactttggtttgtcaatgtatttcgacggtaccaaaaccacctcccaggaaaaatgctcttttgctgccaattccctgtttctcattcctttttcacttagcggcagctttatgacttcactgatctgttcttttgttccataccacccattgaccgcctttgcagtggccagcatattgcccagcatcaatcctttttcaatatcccctcttaatgcttcgccaagatacatggaataatccttggtatgtacaatgattcctttttttacagaaaaccgttctttgatataggctgctcccttaatacaggaatgtatatcatggatttctatgggaaaatcatacatggtgagggtgtactctaattcttcttcatttaaactcaaaatatcaacatatggataaagcatctccaggcacagcttccggatttccctattatgataatgtgcatcttcaaaatatacgatgccagcctcattgtttgccttatattttttgatatgttcctttacataagccagcctttgttctaagatatctttatcctgaatggcgttaaagctggaaaggacattgctcttaatatttgcggcatgagtttctatgtaggtgaagtaggaagccgagaaaggaagcgtttcattgaccgtgattttggttatgatcagtctgtttgaggttggaattgtgatcttctggctgccaaggcaaatcacatctccttttttaaactgaatgatataatgtatttcctgctctgccgtttgtgtgatctgatctgtatggattaattctccttcgttggaaaccgtataaatatatggtgaatttaaaatatcacatacctctttggaatcatccgtcaaatgaatgatggaaggacatgtgactgctgccaaagccatggccccctgggtcgcggttccgcccatgcctttttttacttcaaacgtatccctgatcatgccgaaatccgagatatcaacttctccgccgattccattggtgcagaaatacacaatggtttccaaaaaccccttcatatcagcgatctcttcagccgccttcattccggctaaatccccattgggaagatatttatttaaaagctgattgaatacttctatctgaaaatcacacaatacatccagattactggtgtaaccaagtgctgtgaaagcattattttcaattctgcttctgatcagcggttccatttgttcatacgtttcaatatatttttcctctgtcttcattctatccgcccgccctctcatgctatatataccatttcccataaaaaagatctgccccataaaataaaaacaatcgctttccattttacagggccatgatatgatctttgattagtaaagtgcagcctttccgtccgccttaaaaagccggatcttgtgatatgccacttccttcatggcttctatgcaaggcggttcaatcatatttggttcccggaggctgccgtcttttaaaacctctctcattttaatataatatgccgctttaatatcgctggaaatattgattttattcacacctaacgttactgattccccgatctctttatccggattattggatcctccatggagtaccaggggaatggatactttggatttgatctcttttaataaatccagctttaattccggcttcattccggcagggtataatccgtggcaggttccgattgcgattgccagtgtgtcaacccctgtttcctctacaaatttagcagcatcatccggctttgtataaatgataacctgattttctgtttctgaggaatcggtggttccgattgtgcccagttcaccctctaccgatacatctgccccatgtgccgcttcacaaaccttttggcaaacagcaatattttcttcaaaaggcaggctggagccgtctatcataacagaggtatatcctgcctgaatggcaaccatgatctgctcaaaggaggcgccatgatccagatggatgcataccggtatctttgttttataagccctctgcctgattgcctgaatgacatctgttccaatatgactcaattcatccggatggatcgaaataataaccggcgcatgttcctcttctgaggcctccataattccattgaacatcgcataggagctgatgttaaatgcaggaacagcaaaattgttttcatttgcagccgctagcagttctttcatgtttaatagcatagttttttcctccaactttttttattagatttccgtttccggataatcatacgtattaattttttacagctcctgctgtcatgccggcaataaagtaccgctggaaaaacaaaaaaagaatcaatacaggcaaggagcccaatacgctcatggacatcatttgattccactcatacgcatgctgtcccatgagtaagctgatgcccaccggtaccgtccgcatttcatttgttttggtcaatgccaatgcaaacaaatattcattccatgcctgcatgaaggtatacattcccacggaaaccaggccgggaactgataccggaaccagcactgtccaaagagccacaaacctggaaccgccgtcaatcattaccgcttcatctaaatcctttggcagagtattcatgtatcccgtaatcatcagaatggcatagggcaatgtaaacagcatatacgtaaggatcagtgctccatatgtgttatataatttcaagctgacaatcaggcttaaatatgggatcagaagggtgatgggaggtactgcctgcacgctgacgataagggtattgataacgctttttcccggaaaattaaaacggctgaaactgtaagatgcaagtatcccaatgatcagggtcaaaattaccacaagcattgcaatgcaatagctgttgataaaaaatctcaccttttcaggattgtgaaaaattgaactatatgctttcaaactgaaattcgctgatatccatgtgggcggccatgcaaatatttccccatttggcttaaaggagctgaggagcatccataatatgggaaaccccgaaaacagtgctccggctgccagaaggagcataatcaatagttttatgtaccactttttctttcctaccataatcagtccctctctctctgatgccgcacataaaaaactgctatgacggaacaaacaaccagtaagatcactgctgatgcagaggcctgggaatattgatatttactgaatccccttttataaataaaagtacttatcatttctgtggcattgatcggtcccccgcctgtggtcatccagatcagggcaaactgctgtatcgtccacacaaaatccagcattaacaagctgataataatgggccttaactgggaatggtaatgcggaaaaactgctgtactgcatttgccccgtcaatggcggatgcctcataaagatccgtgggtattccctgaagtcctgccaggatgctgaccatataaaatggatatccggcccatatattgatcagcgttacagaaaacaatgcgaaattccgggaacccagccattctatatgggaagatgtgagattggtgatttgcagtaagtagttaataatcccattgggattcatcatcattttccataagatggcgataaccgatgccgtaaacatccagggcaatacataaatcacccggaaaaatgctttcaaattaattcctatataccttgtattaagaagtatggcaaacagcattcctaaaaacatatgcacaattacactgacacccacaaaaaacaaggtatttttcactgcaacaaaaaatgatttgtctgacaggatcatgccatagttctttagcccaacaaatacaggatcttttttgacaataacattatcaaaaaaagagtaccggaccaccatgcagatggggataatcagcaataaaagcatcagcacaattgttggaaggagataaaggtaaggttcacgcttctttttcattgcctgtgacatcttaccgctgctttcctttttcgttgtttctctttccttagccaactcactcattccctcctttttaacatcaggctgcactatttataatgcagcctgaccggtcgttattggaatgctccctgccaaatctcctgtgttgcggacagcatatcagcagttgatgccgtatcgccgtcaatgtataactgtaattgctcatcaaactgtctcattaattcttctgatgtgggaagcccggtaaattcattgattgcgtagcactgctggtataattcatatgcttttacaaataactcatcagctttggaatagtctggtttggcatttacatttccagggaaggcatttgcatacactgcaagcctggcatttacttcagggctcatcaagtattccacaaacttcatggcttctgctttctgttcgcagttttctgcaatgccaataccccagttggccacatccatgccgctctttcctgtgtaaccttcttttaccggaacaggcatgaattcaaactttaaatcaggcgcttcttttttgatcgttgtcaaatgggcaagtgaatccgtcataaatgcaacgcggccatttgtaaactcttccaccatatctgcttctttcatggaataagcccccggtgcaaccacacctgcatcaaataatccttttacaaaatctacggtatctgacataagcgggttatctgtcaaagccggtttcccatcctttagcatggttccgcctgaagcccataaccagctcatgaaattgttctgaattccgctgggggattctgttgacaaggggatggcccagcccgcaactcctttatttgctgctgaaacttttttacaggcttccgtaaattccccccatgtcttggggacttctgaaatgcccgctgactccaacagcgttttattgacatacatgggatatgcaaagttgactaccgggatcatatatgtatttccgtctactttaatctgatcagataattgtccgtcatcataaccatctgctgacatcagctcagtcatatttgtaatggaaccctgttttgcaaaatcataaacccacgatccgtcaagacctactacatctgccatggttcctgccgccgcgccggctgcaatctgtgtcttggtatctgcataaggattgcttaataattcgatctttacccctgactgttctgtgaatccgtcgcagatctccttaaggacaccatccggtaattctaccccccaccattgctgaaattccagtgtgacctctcctccgcctgtttcgcttcctgctgacgtcccttgtgcagttgtcgtttgctgcgccttttctgtctgtacagattctgttgtctggccgccgcatccgatcagactaaccgtcatacctgctgccagcatggcagccagacttttttccataaacatgctcattttcatctatgtagccctccaatacatgattcgtattcattgctgaatacggtttgtgtttacatctcgaattgtaaatgaatttttatttcatgtcaatatattaatgtaataatatttcttttcggaattattgctaattattactgtaaaatatggttttacacttatattttttgtaataattatacataattacttgttaaatttttgccaaatatgttttcaagaaatttcctttcaccacagtcaaaaaatgtaccctgctaactgatagggaaagccggagagctttcgtatgatgagcagaaagtacgctttgcagactctcctgccggagggtttttatcgtataggacgaactttcctcgataaaaaaagccgccacttctgtgacggtttaaaaacaacgtaatatattcttaaatgattgacagcgttttttcccagcattcaaggtactgcagtataccggattcaatatcaggcaccgccaatgattaccgggaccggatatttaccggctggcatgtccctgctttgccggatggccccattaaaaaagtacccggaaaaagtaagcctctttccgggtaccctgattttttaagcctgtggtttttccacctgaacgatagcagtcttctgcatgggaatcctgcagttcttattgttgccgaactctacaataaccgtatcatcggtcatatcaatgatgacaccataaaaaccgcttgaggtcaacacgctgtctccgattgcaatgtttgcaaacatctcctgctgtttctttttctcccttttctgtggtctgattgcgataaagtacatgaagccaaagatcactgcgatgtagatcacccagaaaccaatgcccatagtaccgcctgttgctgataacataaccatttcctccttatataacgatccgccgcctgcttgtccaccatttttaagaagtctggcctgccatcatgcggcccagcttctcttccttgtatgccccataacagtggttttcgattgcgtcgcggatctcttccatcattgtattataaaaatacaaattatgcaagacacataatctcatgccaagcatttcttttgcctttaaaagatgcctgatataggctctgctgtaggaacggcaggccggacacccgcagccttcttcaatgggcttatgatccagttggtatttgatattgtataaattcatttttccatgattggtgtacacatgaccatgacggccgtttcttgacggatatacacaatcaaagaaatcaactcctctgtccacggattccaaaatgttggcaggggttcctacccccatcagataggtgggtttattttccggaagataaggaactgtttcatctaagatccggtacatctcgtcatggctttctcccacggccaggccgcctaatgcatagccgtccaaatccatggcagatatggtcttggcatgggcgatccggatgtcttcaaaggttccgccctgattgatgccaaacaataactgatccctgtttaaggtatcaggcagggaattgagccttgccatctcggtccggcaccgttccagccatctggtagtacggtccacgctgttttgcatatattccctggtggccggatgaggcggacattcgtcaaaggccatggctatggtagaggccagattggactggatctgcatgctctcttccggtcccatgaatatcttgtgtccgtcaatatgggactggaagtaaacgccttcttctttgattttccttaggccggtgagggaaaacacctgaaagccgccggagtctgtgagaatgggacggtcccaattcatgaaccggtgaagtccgccaaattccctgattaatttatcgccggtacgaacatgaaggtggtaagtgtttgacagctctacctgggttttgatctcacgaaggtcatccgtggaaacagcacccttaatggctcccaccgtgcccacattcatgaacaccggggtctggatcgttccgtgaacagtggttactgcccccgcttcgcacgtccatcccttgcaatgatcttataattcatttaagcttccttttccttgatttctttgaacgatcagcagttacttttgtattctcattcttccgctaaagcagccttgatcataatggcgcattcgatccgctttttctgcatttcgcagccgatttcataaacatccgtcaactttccatgaaagttattggaattggccgcacagcctccgctgcagtaaaaccttgcaaaacagtcccggcatttatcctttgcataaacattgcaaagcttaaattcatcccggatctctaaatttgtcacgcctgtatccacatttcccagaaggaattcctcctcacccacaaactgatggcatggataaaaatctccccagggagttactgccagatactcagttcctgaaccgcagccggacaaacgctttgccacacagggcccctgatttaaatcaatattaaaatggaagaaattaaatcctttgccttccttctccctgttaatgtattccacggcaagtttatcatactcctcaaggatccgtggaagatcttcctccctgatggcatagtcctcttccgcctgagctaccaccggctcaatggacatgcttgaaaaaccaagatcagcaaattccaggacatcctttgcaaaatccatattattgcgggtaaaggtgcccctgatgtaataatccctggttcctctcagctgtgcgaacttctggaatttgggaacgattaagtcatagctgccttttccgttgcggaaggggcgcatattgtcattgacctctttacgcccgtcaaggcttaggaccacgttgctcatttcccggttgcagaattccatgatctcatcgttcagcaaaacgccgttggtggtcatggtaaaacggaagttcttattatattctttctctttttcccgtccgtattcaacaagctgctttactactccccagttcatcagcggctctccgccgaaaaagtccacttctaagtttctccggttgccggaattggcaatgagaaagtccagggcttttttcccaacttcaaaggacatcagtgccctgcggccatggtattctccctcttccgcaaaacaatatttgcaggctaagttgcagtcatgggcaatatgtaagcaaagagcctttaccactgtactacgttttttaaaatcaaccacgtaatcgtgatatacatcctttgtaaacagctctcccctgtcgatcagatactggatctcctccagagcttccccacttctgtttctccgtattttccagcaaggctgctttgcagttcttcccccacctctcttggcagagcctggggcttttccatctccggcaccatgcctgctgcaatttctacggcctcatacatgaccggatccacagagtgaacggaaccgctgttgacatccataataatatggaagccgttgttaatatattgatgaatcacttgtattctccttaattgaaaaaatttgtcctataattggttttaagcagacaagcgaaggaacccctaccgtcatcacgaccgtaggggcatctgcttatctgccttatggctgttctatacagttatttccatccacattctgcattcatatgtaaacgcaggacgacacagctgttcactaacggttgcggttctcgcagctctggtttcctactgtacaggatgtcttgcaggctgactggcaggaagtctggcactcgccgcagccgcctttcttcatggattcttttaatgtactggaatttaatgttttcacgtgtttcatatacttacacctcctgtattcacctaattctttgagattataccacatgttttaagcgagcgcaagatgaatcgccccagggagaacgtgccgtatcaattttattgtcaggacatccaagaatatccgccatacccctagaatatactgaatcataagacaagatataaggagtagtcaaatggaaaaatcaaagcttcaggtcacactaagaaaccttcttatcacctacatactgaccggaatcctgctggtggtcctggccttagcactttataaattccggctgaaagaaggacagatacgcctgggtgtcaatgcggtttatattatcgcctgtctctttggcggaatcttaatgggcaagagcatacggcaccgaagatttttctggggtcttttgctggggcttctgtatttcctggtgctgttagccgtatccttcttcttaaacaaaggattaaacggttccatgaaccagctcctcaccaccatggcaatctgcgcagtcagcggaaccgcgggggaatgctcagttgacggatgggggccctgggaaaaacaggaaggagagaaaaagcggtcagcttttctctcctttttgcttttcttcccctttggcaaggacccttcagaccgcctgccagggaaatatctagtgaggcaaatacatccgcaccttatcgatcctgtttttgtccagctcgtccacaacaaggcggattccgctgcagacaacctcctctccctgttccgggagccggtcaagcagtccgatgatcaggcctccgatggaatcataatcctcggactccagttcaaggttcagccggtcgtttaaatcatcaagcttcatggagccttctaccagatattcaaatggcgctacctccaccagttcattctcttcatcctcgtcatactcatccctgatctctcccacgatttcttccagtaaatcctccagggttatcattcctgccgttgccccgtattcatccagaacaatgaccacgttattacaggtctggcgcatctccaacataagttctgcagtctttttatactcgtatgtatagagaggctcccttaaaaaatcccggacgtgaaagtcatcagtcctgtccacaaggagtaaatccttcatattaatgatcccgatcacattgtcactggtttcctcatataccggaatcctggtgtacatttcctgccggaaaatttcgatcagctcatcataagctgcatttacatccaccagggtcatgtcaatgcgggggatcataatatcccgcgccacagaatccccaaaatcaaatacattgttaattatttttctttcttctgactcaatcacgccttcctcgtggctcacatctacaatggtccgcagttcatcctctgtgatcgcatcctgctttcggttgggattcacatggataaagcgtaaaaagcctgaagaaagtatctgaatgacataaatgaccggagtcatgacaatcataaaaccatagattattttcgcatattttaaagatattgtttcggaatataaggtagaaatggttttcggggatatttcaccgaataccagaatgaccaaggtaaggataccggttccaatgccgatggccttactgccccaaacgctcatgaccagagtggtggacatggaagaagccgttaagtttaccacattgttaccgaccagaatcgcgctgagcatcttaccctggttctctaaaatcttaatcagcgtagcagcattcttattgcctgcttccgctaaattccggactctgattttgttcaccgtagtaagggcagtctcagctgatgagaaaaatgctgacaatccaactaaaaaaattaacgtaagcaactgtatatagtcactcgaatccaaaaagatcaactcctgttttttatattttatcattgattctacaatacaaaagcggctgtgtcaagaagacagccgcttttttctgctttaccgctctttaaaagcctttattatttctataataagcataattccggctcccaggaagataaacatatcccccagattgaataccacctttttaagcctgccgcactgaatgctgaaataatccaccacataatggcggacaaatctgtcatacagattgctgacggcgcctcccaaggcaacagacagggctaatttttcccaaacgctgccttttttctgaagaagacatgccagcattccgccaataaaggacgccactgccaggggaatcatctgtaccaggggctggtgatccttaaaacagccgaaagaaaaaccggcattatgatttttatggagcataatctttccgccgcttccctccagttccttgggaaagccggtttcttcctgatcctcgatggcaccttttatgagaagatccagggaagccagtaatacgatgataccgataaataccatgacccacactccttccgtccttattatctccactcttttgtattttttatcccttgcccagcaattcccggctcatcagcatctcatctggataagaggaccgccgattttatctaagtaagctcttgttatgactacggatccgatgttgggatccttgggaacctcatacatgatatcaagcataaaattttctatgatggcccttaaagctcttgctccggtctttttcttaagggcttcttctgcgatccattccaatgcctcatcttcaaataccagattcacttcatcaagctccaaaagctttttatactgctttaaaatggcgtttttcggctcctttaaaacccggatcagcagctccttatctaaggattccagagtcactgtaatgggcagacggcctaaaaattcgggtatcatgccgaatttgcgcaaatcctcattggtcacatgggacaggatattaggatccttctcatacctgtcctttaattctgctgaaaaaccaatggatgatttctccttaagcctctcctttataatatcctccaggtccgggaacgcccctccgcaaatgaagaggatgttctcggtgctgactgctgtcattggggtgagggcatttttctggttggagcccaccggtacctctacccggcttccctctaaaagctttaaaagctcctgctggacagactctccgcttacgtccctgctgctggtactcttctttttcgcgatcttatcgatctcgtcaataaaaataatcccccgctccgccttttccacatcgttgtcagccgcagccagcagcttggaaacaacgctctctatgtcatcgcctatgtatccggcctctgtaagagaggtggcatcggcgatggccaggggtacatcaagaagtctggcaagagtctttaccaggtaggtctttccgcttcccgtaggaccgatcattaaaatgttggatttttcaatctgcacagttccatcttcatccttcttcccggaatccgttaaataaactcttttgtaatgattgtaaactgccacggaaattacctttttggcctgttcctggccaatgacgtattcatcaagcttccgcctgatgacatgaggcgccgggatgtcttttagtttcagttcctgccccggctccttttcggctctttttttcactctctgcttattggggatctcaagatcttttgggtttaagctgccaagatcattgaaattcaaattcatataaggcatattctgaatctttgttatatcaaatccgccctgggctacggaatcaaatgccttttgcatacaatcatggcacagattcatgcctccgggcatagaaaccattggccctgtcacattctccggcctgcggcagacataacagattttttcatactcatcgtcatcttttttctttttgccggcatcagagctgccgacaactgtatcttccatcttttcctccggaaaatccttctcgttcaagctgtaatctccttctatctgtaattatgcacggataccagattattataaagcatttaatagtctcttacaagtgcggaccggcagtttagacttttttaatgagtccggctgacatccggcctgacatcttaaaaccattataaccaattggaacacgaaaatatagcgcggaatatttatggaaaaatattccgcgctattatgtcatttttaaatttgccgggacttaaaacaaaccgcctgtcctccggcagctgcctttctattccgccagagccgcgccgagggctttgcaggctgctacagcctcatcatcaggcgcttcattacagatcacgctgtcacaggcaagctccaaaccagcgcctttgcaagtctcttcccatgtacgcatccattcgccgtcaccccagccataggaaccaaacagcgcgatcttttttccgccaagctttgactgacaggcagaaaacataggttcaaattcatcttcctccaaaacttctcctcccatggcaggacagccaaaagctatcgcatccagggaatcaatcatggaaacgtcaaaatcagagggtgtgaatatggctgcatctccgcccttttcctttgctccctccaggacagctgctgccattgcctcggtatttccggttccgctccaataaactactgcaattttactcatgctacataaccaacctttcctgataatcaatcttttatatcaaacggctacggtgagccgttcaacagcgattccttttgaccattgggcaaaataaacttccgtgcattttttataacgatgaaaggtttgttttgccttttcctcgtcaccgtaaaccttccagcatccaatgcatttacagtgacaggctttgttttcgatgaagccttgaacatcctccgggggatagcccaggaacaaaccgatttcgtgaggaaacccggggcaggtgcgcagcttgtttgccagctgaaccacacagcgctctggattttcaaaagaatatccgtattgcttcagcagagacgacgcatatccatctgccagatcccgccttaaacagcttggacgataaagatagatcaaggccctttgtttgaaataacgcagaggcagaacccggatcccctttggcgcaagggcacggtttagccttcttacttcatttcgtatttcctcctttgaccggtaagagcaggaaaacagatttccggtttttatcccggccaatgttggagcgcagtgcctgatcagcatttcgtctgacatttcttttcctcctatactgcatgttctctcagtatgttctttaacgctgacattgagctggaatgggaacgggcaattatggtatccagtccctttgtttcgctcaaagcacaacgcaccattttatgtgacatggtactggtaaaaagcaccagcaaatccggtcttccgattttatttttcagcccgccttttatctctgtaaagacttttgcgcagcagctgtactcctgacatagctctttgtactgacgtaccatgcattcatttcctccaacgattactacgctcatgcgattacctccattcctttagttagttttagctaactatacgttaaaatgtatgcgccccaaggcgctgtcaatgattgtttttttattttacacaaaaaggatggccccctccactccaaaaggaacaaagaaggctccaaatggacacattgtccaaaaaggcggtccctttccgtcatttatgtatcctcctgaggctgttcttcctcattccttgtatttctgtattcattaggcgtcatacccataacattgcggaacgcgccggcaaatttgctgccgttgtcatagccgcacatccctgcaatctccagcacagaacgttctgtctggcgcagcattaaagcagctgcctgcattttctgctctctgatgtaggaataaacggaaacgccgaagacccctttaaagctgttcttaagagctgtctgagaaacatggaaaatatccgccagctcagaaatcgtcacccggctgtccatgtgttccgccagatactcacacacgctctttgtaaggccaacctgggtttttgtgaagcagcgcttttcaatctgatcctcacttaaatccatgccgcttaaaaacagcagaagttccagaatcttgactttgaaatagccttttcttatgctgtcaggtacggcatacagctctgaaaaaatgtgttccaggcagggttttgaccgggcgacaaagcatttaccgcctctgcagaacttttccatcaggacacagggccgcacattcacatcatccagaaagcatgacatacacgcaggcgctctgtcaatgtcaatgacaattgcgatcccgtgatagtggttcaaagggaaataggagccgtgaccggcggcacctgttttactgactgcaagatcgccctgggtcaggtaaaaaaactcttcccggtacccgcactctatgcgcccttcccggcagtgattgatctccattacatttccaaaaactccatagtcaatggaacaccttcctatatgtacatcgttgtaaatcagctggattccagggaacacctgataactggtcatcaccatagctccgcttccatcaacaatgcggtaaataacgcagtcgcttgaccgggaaacaatctgtacctcttcgccgtatatttctttttcctgctgtgtcgcgttcattatttcacattctgaaaatgctcccattgcttaattattaccttccattttgttttctgtctaccataaatacggattatgaaaaactgctaactttttcaatgatatatttcctgttcatgcccgcaagtacaaatggcatcatggttcagccttcctcacattctgtgctctatgggcaaaacagagccaactgatcaaaacatggagttagcttacactaacccatattacaatacctggatcatttctgtttgtcaagagctttttcaaaaaacaatcatcttcctatctagaccacaactgctgctccccctttaaaaaaggcctctccaggctcgatgaggagcctaaagagacctttttcttaaccctgctgcggaacctcagacggtcttttgccaagggtaatatctacatttctctccacatactgcccgttttcaagagactggacagtaagagtcacggtggttcctccttcgtaatatttaagcatgttggtcaggtcgtcataagtcttaatgccctggccgtcaaacttggtaatgatatccttttcccgcagttcagacttggaagctgctccgccttctacgatcttatagataaacacgccctgaggcataccaagctgctggcttgtggtcccatcaatattcttgcactggattcctaaatatccctggttttcatcggccacctgggttctggtctttctggtcatcagggtgtcaatgatatcctgggccttggaaataggaatggcatagcccataccttctacttctgtagaagaatatttggctgaattgatgccgatcacctcgccccgcatatttaacagagcgccgccgctgttgccggggttaatagcagcatcagtctggagaagatcgcggcttgtgccatcctcagtctgtacggaccggtcaagagcgctgacataaccaacggtaacggactgtccataaccaagagcatttcctatggcaacaactccctgacctaccttcaggctatcggaatttccaagggaagcaatggcaatctttgataatgtgtcggaagatatgccatttaaaggaactgcaatcactgctaagtcactgtccgcatccgttcccttaatggaagcatctacggcctcttcatcaataaaggtgacctttaattcctccgcgccctgcaccacatggttattggtgacgatcagcagttcatcatcgttttttcctacaatgatgccggagccgctgcctaccccttccctctgcatagggccgaaccaggtctggctttcataaatcaccttgctggtaatggcaactaccgatggcatggctttgtcaacaatggtggaaacatcgttggcagcggtaatactggaggtattggcagcctggactcctgccggatcagtagtagatggaatggtttccacctggctgatttctacggaatttttatttccgtaagctccggccgcccagttaattcccaccatggtgcttccggcaaccacaccaaagacaagagcgcctcctacaatgccggccgccttctttgcaaagctgcctttcttccttggcttcccttcttcctggtacacattttgttctgctgccctgtgatactggtactcctggtaatgaggaatactctgctgtgcgctataggaactgcggtcctggatctgattgccgctttcagaatcctgggagctgggtttttccggatccggatccctcataataaaatttgtggtaactgcttcttctttatgctcttcaggattcacacggcctgtatctttgttatcatattcgtcatacataagatctatctcctttcatgtatactttttatctcttttgataatctgagtttatcaatgaaatgtgaccattttgtgataaaattatattgaatatgtgaaaagaaaaaaatccccgcatcagccgccttttttatcatcagggccctgtctgcggggtatttctttatcatttattcaattaattgccggtgggcggtgcagaaaccacaggaacctctgaagccggattggtggcttcattagaaggctgggaggacgtcgtctctcccggaccgcctggccctgccgaggtggtctgaggcgccgttgtctcttctgctgccgttgtctggccggttccgggcccatgagagtctgtagttgtctccggcgcactggttgtcggagaaggctttgtttctcccggcttcgttgctccggtagttgattctgaaggtcttgtctctcctggtttggtttcctttgtctctcctgtactgccatctgaggaatccgtaggctttacaggttttccgttttcatctgtagctccagtagacccgtcctgggaggaggattcctctgccccggtggtcttctcaggctttgtggcttctgtggtcttctttgaatcatcttcatcgtccttagaagagttgcccttgccggatccctgtttatacatgccggaatcggcggctattttagcgcttattttcttgaccatatctgatggctcatagttttccttatcaaaaagaagactgtgaagctcagaaacatttgattccagagtctgagggatgacgcagtcccctctttttcctacggtcatatcaccgcgggtaaagggaaaacctcctgttttgccgatatgatatttgcctatatccaacagcagctccgtaaagtcgctaaaggtaaggtttgatccgatctgatccacctccatcaataagattctgttaagcagccctaagtctgccttttttgccttttcaaaggttttttgaatcacaagacgctgacgttctgttcttgcatagtcggtatccatttttctcagtctggcataggctacagcctgcaccccgtccaggtgattcattcccgcagattttaaatggactgacggcactcctgttttctccacagtttccgtgataaaggagttgatataacggaattccgctttggtaatttcaatgtccaccccgtccagcatattgatcccgtcagcaaccgatttccagttaaaggtaacgtattcgctgatatccagatccagattcttatttaaggcagccaaagcctgagctgctcctccggtggcataggcagagtttattttattataggcatttccctctcccgtatttaaatatgtatcacggaacacggataccagcctgatttctccagtatctctgttaatattgcagaccatgataacatcggcattggttcccttgtttacattgccatcccggctgtcaacgccgaatatggcaatggtacggtaacctgtcatatgcttcttctgttccggagacatgatctcattgcgcacctgtttctcattaaaatcatccggtctttgaatggatcccatgagtctggcaacgtaagcataggcgaaaatgcctgccagagtaaagatttccaggaccgccatcacaatgatgcggcgaatttttttcttcttttcagcctgggctgcagaccggctggcggccacactcttctcctgtcccggcactctctgctgctgcttggcaactccgtcccctatgacaatctggccttttgacgggccctggccgtttatggagatggaccggcttactgctgcttccctggcactccctgaagcggacctgctcacggctccctcccgtacatttcctgatgcagtacggtttcctgctgctccctggccgcttcctgaatcagtccggcctccggccattccctggctatttcctgaagcaccgcggtttcctgctgctccctgactgtttcctgacgcagtgcggctacccgctgttccctggctgtttcctgacgcagtgcggctacccgctgttccctgactgtttccagagccagcacggtttcccgctgttccctgacttttacttggaccggctcccgatgaggtttgacccttaaaagctgtctggccggttccggatgcagtattgggtcgttcggcactcctggccctttccccggtcctgctttgccttccggccgtatcaccagcctttttggtgaaatcattccggacttccgcctgatttgttctgctgtattttctttcctgataatcctcgtaatcatcatccaggtagtaatcttcgtcagacggatctggttttgaatcgaaaccgcgctttccttttctaatatcctcgcggcttacttcatcgtcaaattcatttctcatttatttaacctcatcctaactatgtcgtatccaatatcagtacgcatttttattgataaaccctttgaatatggtaaggaataagatcttaaaatcaaatcccagggtccagttttcgatgtaatacaaatcgtgctcgatcctttttgtaatggaagtatcgccccggtatccgttcacctgggcccagccggtgattccgggacgcacctggtgcttgatcatataacgggggatctcctctttaaatttttcaacaaagagaggccgttccggccttggccccaccagactcatatctccccgaaggacattgaaaaactggggcatttcatcaatgctcgtcttccggataaaacgtcccactggtgtcacacgggaatcgtgaggagtcgtccattttattttttcttcggatggcgcctgcaccaccatggaacggaatttatacatatgaaacgacctgttgtgaaggccaaccctctcctgcttgtaaataagcggccccggagcagtgagcttaatgagaaccgctgtgaccagcatgacaggggaaaataaaatcagagcaaccgaggctccaaaaatgtccaccatccgttttaccagggcattcacagtatccgtaagaggcacccggcggatgttgactaccggcaggccctgtaagtcctcaataaagggccttgttggaatcatgttattataatccggtataaacttggtatggacgcctgatttttcacaggaagctacgatttcttccaaattcgcatattcgctgatacttaaggtaatggcgatttcatcaagagaatttaatgcaaggatctcatctaagtcatgaaccttgccaatgacattgatccccctgtatcctgatccccattcctttgtgtcatcaaggatccccttgacctgatagccccattcaggattcacccggaccctgtctataaaaccttctgccgcacggctgtaaccgatcagaaggatgtgcttctgattgtagcccttggaacgcatggagcggagcatggaacggagcagattccgcacaacggtttccagaacaatgttgacggcgcagaaataaaataccatcctggtggaaaactcacggaaatagggattcttctttgccagaaataaggccagggaaaaaagcagaactcccaaaagattggccttgcagatattggcaaactcataccgcctctcctggactcttttcggcgcatacaaatggaagatgccgtaaagcagtaaataggtgggcaatatgataagaagcgccgcaaaatagtactgcggtcccaaaacctgcttataagggctgaacaaccggtttcccagcaaaagaagcagccatgccaatacataagacgtaacaatgaccagtccatccagcactacgtgaaacccgtttaattttttctgattatccttaatcatagcagcaaaaccttccattcgtgcatcgcaccatacttctccaccataattcccgtatattatacatgatatgtcaatatgatgccattaaaatattcttaaaaagacctgaaaatttttaactttcttcgtaaaaattcccatatatagaggaaggtgccaaaaatcagctcgccttcgatccgaaagtaatttccaaggtgctccatccgaaaccgcaccttcttagtgttttttgccgtccttaagccctctttcagcccctccacatagtcggaggcaaaaccgatcttccggaaaaacatgtatttcacacagattcccgctaagataggaagcagattcaccaaaagctgcaaaaccggcatattcttataatttaaataaataatgttcctggcagccagacggaccttaaaggaattatacttggatccgctggttccgctgcccacatgatagaccacagctgttggacaatagaggtttatatatccatggatctttgcccggtatcccacatcagtatcttccagataagcgaaatgagcttcgtcaaatccgcctatttcctcaaacgctttccgcctgtaaatggcggctcctgcgcaggccgaaaacacgctgcggaccttttgatagcccttgctgctctgtcccacgcccctttgatagacccagcccaatatgctgtacatatctccggcatcatccataagctctttatggtaaagctgaatcatcttgctgctgacggaaaatatgttcggtgaccggtccatggcatgtaccagctccttcacataatcaggctccggctccgtatcattgtttaacaaaatgacataaggtgttttggtatggcggattcccacgttcacagccccggaaaaacccgtattttcctccaggaaaatggaggagatgtttttctccttcagccattccacgcttccgtctgtggaaccgttatccaccacaagaagctcaaagttcttatcactctgagcttccagggccttaaaacagggttccataaattttaatccattataattaggaataacaaccgttacttttttctccatctcacacctcaagcttatagggttccccaattttttccttccgcaggtcccgcagggcaaaattggatttgcgcagggttaagttagggttgtaataaggatccccatcctttaggatatccggccatttctgagaaaactttttgatctcctggttaaaacgttctaccttctccggcgtgtcctcaagccctcttgattttgactcataatgataaaacaaggcataaggggcataaaccaccagtttccttaaggcgcgaatcttcatgcagtaatcaatatcgttaaaggcaacagcaaggtcctcggaaaaacctcctgctttctcaaacagagaccttttgctcatcatacaggcagccgttacggcgctgtaatcacgggcgcacatagcctggttaaaatagctgctttccgccttgtgaagtccgataaaggtgtgcccggcaatgccgccgaagcccaccaccacaccggcatgctgaatggtgtcatcggaataaagaagcctggcaccagcaatgcccacatcctccctctggcagaagcctaacatctcatggatgctttccggattgatcatttccgtatcattatttaaaaacaaaagatattcaccctttgcatgggtaacaccaaagttattgatggcagagtaattaaactccctctcccacttaaccacatggataaaatcaaattccttttggatcctgtcataataagcaaaggtttccggatcaatgctgttgttctccacaacaatgaattccaggttctgataggtggacttctctatgatggagcgcacacataattccaggtcagcgctgtgatccttgttggggataatgatggataccaatggctctccagtaattttaaacctggtatgataaattccgtaatcaatgcccttttccacagacagagccggggtgcccacccggtcataatgggccttaatggcccttgctcctgcctcaaaggcatataatttgctctccggattgctagaggtggaattctggtggcagcgccagtgatacagggccttggggatatggtaaatccttctggccttttccgtgcagcggaagatgaaatcataatcctgggcgccgtcatattcctcccgaaagcctcctacctccatgagcagctcatggtttaccacaaataaatggcagatataattgacgcttgttaaaagatcaaggttaaaatccggcttaaaatggggttcaaataattctcctccgtcaatgtcaagcttgtcctcgtctgtataaaccacatcgatttccggatcagaattgatcgcccttacacattcaaacaaagcgtcaggtgctaaggtgtcgtcatggtcagccagaacgataaaatctcctttggccatttcgatggccgcattggtatttcctgcgatccccttattctctcccaggatcacataccgaatccgttcatcctttatggcatagcgcttcaatacccgttccacgccctccccctttgggcttccgtctgcaatgcacacctcccagttcccataggtctgggccagcagggagtccagcatggctgccagatagcgctccggagtcttataagcgggtattaccacagacattttgggcatataatcaaaaaatgactttctctgggcttccagttcctcatccgtggttttcgtaagggcataccattccggataatcataatcgctgtcaattccctgaagcttatgtctggattttagtacaaaagccttaaagccgttttccttccagaagtccacagcagaccgaaaggtctgtacattcatcatacttttcagctttgcactttttttatgggcggagctgttctgtctttcaatgatttcggcgtttaacttcactctggcagttttcccgtcacaccggatcaccagggtcctgtcctcattcttttcccggatataggggatccggatatcaaaccctaaatccctgtccagcgttttcttaaagtatatctggcacacatcatctctgcgtactggaacatacttaaatttcacaggcttttcctgtccgtccaaaacctcaaactctgcttcagactgaaggctctttccaatgacccagccgtttaatacgattgaattttcacggattcttgctacatctatcttatatttcatttctgatccccatcctcaatggatgccgccattaaaagcatcccttcttctgaactgttttccgctttttgggaaaaattgattctctcttcctcaatgaccagaggccgcttcatgacacgggcattgatggataaaacgtattctcccacaaggcctataaaaaagatctgtacggagccaagaaaacacatgccaatcaggaggggcgccatgccggccgggaaacggtcccagtacaccagcttcatcaccagataaataagggctaccatcatgctggcaaaagaacagatacttccgaatatagtggcaaggcgcagccctaccttagtataagaagtaacgcttaacatggcagcatcatagagacggtaaaaattgttgctcgtcttccctgcccgtcttttgggctgttcataggggatttccctgcgcttaaaaccaagctccgccacaatcccccgaaggaagggtgtcggatcgtccagctccttaagaaccttaataaattgttcatcatataaaccaaaaccggtaaaatgctcgatctgctccacatcggaaagttttttaatcgttttataatagcaggttctcaaggcatacataagcttattctctttgctggatttcttgatcccaatgacgattttataacccttttcccattcctttacataccttgggatcatttccaccgggtcctggaaatccgcagccatgagaatggtacagtcacccattgactggagcatgccgtaataaggggaattgaactgtccgaaattcttggcgttaaaaatcccttttaccttcttatcctgagaacacatacttcggatgatctccctggtgcggtcctttgaatcattatcaataaaaatcagctcatagctgtaatttggcaaatcacttttaaatatacggtcaatcgcctggtacatggaattcacgttctcttcttcattataacaggggatgacgatgctaattgttttcatatgttcacttccaatctatccgaaccatcactttaattaaatcttccggcttttctttcataagctgtaaggcggtctccacctgatccaggccgtaaagacggtgagtcaccagcttttccggattgatccttccgtactggaccatttttaagaggcgttccattctcactctgccgccctttgcaagctctgtgtgtatggtctttcctgccatgccccgccctccggaaaacttgggaaagggcaggtttccggtaccgccataataattcacattggaaatggttccgatcccatacctggccatatctaccgcctgggcaaagacttcatccccgcctccgcagataatgacactgtcagcccctaaaccggctgtccgttccatgacctgatccgtcacatttccatccttatagcttaagacctctgtggccccgaattccctggcaagctttacacaaatgggcctgctgccaactgcaagaatcctcgcagcccccaggtggcgcgctccttccaccgccatcagcccaatagggccgattcccaggaccactaccgtatctccgatttttatatccgcagattccgctccggtaaaaccggtagtaaccacatccacgcacataagggcctgctccagggtgatcccctcagggattttcgccaaagtggtatcagcatccggaatcaggaatttctctgcaaaaactcccggtgccgttcttcccagctgatggccggaaaatggagcagacgcgtgtttaaaattcccctcctgaacacctaaggctctccagtccggggtgattgcaggaaccactaccacatctcctgccgcaaaatcgcagaccagttccccggtttctaagacctctgccacacattcatgtcccaggatcaggttgggagccttccgggaccctccgccatataccgtatggacatcggaggaacagggggttaccgccattgggcggagaatagccccataaggagttacggccggttccggtgcatcatgccagccgaccttgccaggttcgatcaaaacaaaagctttcataggtttttcttatatcctttccaaatgattggattttaacgccagaatctccacattccggccaaatttttcctgtatgattcccgcgatctcatccgtatagcctggggccacgatcaaaatggcatctgccgggtccgtatgataatgatccggggctacgatgggaaggtgggaggcaggggcgtactttccctgcttaaagggagcggaatcaatgatgtatccggcaaaccggcccacagccgttgtagaagccagtgtaaacccctgatggctggctccccatatggccagttttttcccacggtcattcagatcttctgtcagttctcccatctccctgccaatggtatccagactttctttcaggcctgatacgtccacggctgaccgctggctgtcagataccggctgaccgtccgccttctttctttttctcacaataacagaaagggtatcccggttcaccatttcttcctctaacacttgaaaaccggccgtttccaccgtaaacctaagggtatcaaaggtataataggctaaatggtcccggatcaattcgtaatacccgtcatgttccagaatatattccaggcttggtaccgtaattaggcccacgccctcctctgataagttgtccgcaatgcatcggagcattcccaccggatccggctggtgttccagaaaattaaaggacaaaaacccgtcataggggccgcttgcgctgccgtcatcgggtgcaaggacttctcccttttctgcaaactgtttccagaccgcaaggcccctttccctggcaagccggaccaggctttccctgttttcgatcccataagcctttacaggaaactctgataacacagaaaggaattccccctggccgcatccgacctcgatcagcttcttcccttccagatggtatgcttcaataaaatgccggtactggcttcttcttaaattcaccattgtggtggtaaatccgccggaccggatcacatccttgtagtatgccacaggctcacagtcaaactgaaccagaccgcaggtttcgcactgatgaagagaaagggaaatcccatgctcttccttcatttcttcctgcccggggatatcctgagccgaagcgggcatacccccaagggtcatcaaaggtttcccctcaagaggattgccgcacacaatacaaatcttatctctcataccacaaaaattcctccatgtcaatatttttacatcccaggggttcaggggcatatgtctgtatatccggttgatcccagatgaaataagggatactgttcataaacagaaggttgaaacaggcttttttcagccttcagtcttatacgtccgccggatcccctcccggaaactcacaagaggctgccaccctgtggtcctttccagctttttaatgtcagggataagatttgccggtccctctgcattaggtgcccttctgccgtagctgtagctaccgtgaaagcccaaaacctcatacatgatccggatatattcccttaaaggacggttttccccttccggcccagccacattataaattccggaaactgattctttctcctgttccattaaaagtatcagcgcccggatgcaatcatcaagatataaaaaattccatatttgcgtacactcccccagggaaatatactctcctctgccaaatgccttaagacagctttccaccagggaccatgggtgatcccccggcccgtatacgctgaatatcctggaatgaatgtattccatatctgaaacgccgtttttcctccagttctccgtctgctccgccgctcttttaaaaaactccagcttggccctgccgtattcggatactggtctgcactctgtttcctctgtcatggcctctttatgaattccgtattccgcctgggaaccgctgaatagaaagcgtttgcagccaaggcgtctggctccttccaaagcctttaaggaatcctccacgttcttttgctgcacttccggcttcatccggttctcacttcctgagccatcccagccaaaatgataaaatgcctggcatggcttaaggatcacctgatcaagctcatgaagctcctccaaattcctctcaatccgtataaggccctggcgttttgccccaaggcttcccatattctttgaaccgggccggacaaccgcatatacctggtttttctcttttaaaagccggtcaaccaatgctcttccaagaaaactggtggcccctgttacaacaacgttcaacgtttttcctccccttgctgttttttatttctgcaggatagggcatgtttgaaaagtgcttgttccaagctttacgttccgctttgtgggagatttgctccagatgaaggcgacgcagtaggctgcgccaactgaatctggggtaaatataccgcaaagtggggcgtgcagattggggcaatgatttttcaaacacgccctaggacccaggcgcaggaatgcctccattcctgcgtccagccaatgctgcaaacgttcacatgctccgcggcatgctgcagggtgtatcactccctgatccgggaaataatcatattccggtccatctcctcatcggaaaggaagggagacagatcctctaaaggcggcgaaataagagttccgtcaggaaggcgctttgcagaagacttgggttcaaaattctgatccatgcttacgaaaacctcacagatgacaggcccttctgtcgccagtgccgtctcaatggcattttccagctggctgttatgatgggcgcacacataagggtatccataagcggcagaaagcttttccatatccggaaagcttaaatcatggctgtccactccgattcccaccaaaggctctccgaagaaattcttctgggtctggcgaatggaatggtaacctccgttattgatcaggaaagtcttcaccggcatgcgatgatgtataatggtctgaagttcctgtaagttcatctggatgctgccgtcacctgttaccaggatgatatcctctcccggcgctgccacgcaggctccaatggccgcaggcagatcatagcccatggaagccaccgctgaattggacaggaatcgctgtcccttcttaatcaagtaggcatgtcctcccacaacacaggcagaaccgtttcccaccacggtgatcctgttttcaggaatgcgcttgctcagctcattgatcagagcgtaaacatttgctccttcatcctctccgccggtgtaatgctttgggagcacgaccggataggtttccttccatctcctgcaggtttcattccaggtcatggaatcaaggccctttccgccggaaaacaggggctggtcaggggttgccttgtattctgaatccagaagctcctccaaggctgtcagaaggtcctttacatgagcgtggaccggcatatccgcgtgaacggagggcttttttaactcctcagggtcaatgtcattgacgatcacataggcctctctggcccatgtggtataattgtaccctacctggcggatacttaagcggcttccgagggaaaggaccaggtcgctgttttgaatagcaaaatttcctgcacggtctcccattccgccgccccgtcctgtgtaaagaggatggtcttcctcaatgcagtcctggctgttccagccggtgaccacgggtattcccagcttgtccactaccctcaggaacacttcatgggcctgtccgatattgatcccgtttcctgcattgattaccggacgggtggaggattttattttttctaaaatggctctggcagtatctgcggatacctttttcggaaggacctggcgcttttctccgcatccggcctcatcctcttttatctttgcttcgcttttaccggcccagccgtctccgccctgctcatagtcttctgctgaaaatccaaccagatcgtccgtctcaatataggctccctggacatttaacggaatgtccagccaggaggggcctgggcggccggaataggccaggtaaatggctttttccagagtgtagcggatcctcatgggatcaatcaccatctcgctgtattttgtcatacagtcaacggcctttattatgtcaaactcctggtctcccatggctctgatcccaactcctgaccacctggcagtggtgtcataacgcacctgaccggataaaatcaacataggaatggaatccagaaagcctcccagaactcctgtaatagcgttggtcccgccaggacctgtggtcacgcagacagctgcaatgtgcccctctattctggcataagcctctgctgcaatggcgcaggcctgctcgtgatggttatataaacagtgcaggccttcctgatgccccaaagcatcgtttaaatgcatggctcctccgcctgtaacggtaaacacctgtgtaatcccggaatccaccagcttctgggagatatagttggatactttcattctcatggatcgtctctcctttcctctttctttccatatttactgacatggagatatgcctgtatggtattttgaggaatgtttttttattgtccgctgggcagcttgcgaatcctgcggcttctggtccgctgggcagatacgtatcatacggcttctggtccgctgggcagatacgcatcttgcggtttctggttcgtactgctgctacgggtcctgcggcttctggtccacactgctgcctgcggatcctgcggcttctggtccgtagtgctgcctgcggatccttcggcttctggtccacactgctgctacggatcctgcggcttctggttcgcgatgctgctacggatcctgcggtttctggtccacactgctgcctgcggatcctgcggcttctggtccgcactgctgcctgcggatccttcggcttctggtccgtagtgctgctacatatcctgcaacttctggtccgcagtgcagcctgcaaatccttcggcttcgcaggctcacaggcattcgccttatgaatcagaactcgaaaaaattttcttacgtgcaagcacgacgtaaatttttttgagttctgattcgcactgctcattgcttttgtgaagattataccacaccccccttattttcctattaaagttttcttactttataaattcgaaaagcttccatttttcgtcagaaattccttgttacggaagatttctgccgggtttatgggggaacccctgggttttctcttgttttttcttgttatgctatctccttccatatctgccagcaaaccacactattaaagtaccttcaaggtacgttataatcgcagagtaatgcaactatggattttcggccacgataaaacttattgcaaaaaaggagagaacatatttatgaaaaagcatttaaaattgatggctgtattatccgctgccggtgtattaaccgtagcagctccagagctgggcttaatcagtacagcagcaaccgcttacgcaaaagtaatcggctgggttgaggaaaacggaagctggaaattttatgacgataatgatagttacgtaaccgatgcctggaaaaagcgcggcgaagactggttctacttaaacgaggatggcgaagtcgccactaatgcacagatcgatgaatattatgtagacgaaagtggaaaaagagtttctgacaaatggatttccatggaaaacgaagaattctgggactctgctgatgcccctgaatttttatggcattactatgggagaaacggtaaggaaattatttccaagtggcagaaaatcaacgataatcagtactacttcaatgaccagggtgagatgatgaccggaaaagtcgatattgaaggaagtacttattatttgggtgaagtaggtgacggtgtcatgaaaacaggctggatcgagcttgagaatgattctgatgatcttgacgaaacccattcctggtactattttgataagaccggccgtatgatagacaatcaggtcgacaaaaagattgatggtaactactatacctttgtagacggaatcatgcagaccggttggtacaagcttccggataccgcaactgcttccgaagcaaccgttgatatccagaccgcagccggataccagtactatgatctggaaagcggagcacgggttgagggttggaagcaaatcgaaggtattgaaggactcagcgaagaaggcgagatctataccttctatttcaagaatggcgctccttattccgcaacaacaggtcttgaattatttaccattgattccaaaaaatatgcattcaatactaagggagaaatgcagaccggactggaagtcgttaacttagaaaacggcggaattgccaacttctactttggaacagacggcgcaatggctaccggaaagcagacaatttacaacgaggatctggatgaagatcaggtatggttcttccagacagaaggaacaaacaaaggccagggagttcacggtgtccgtgacaacgtcctgtatgaatatggcttaagaaaagaagctgatgccgatttaaaggttgctcctatttcctttgaaggcaagcagtaccttgtaaatgccagcggttccctccagaaagcaacctcctcttccaagtcagctacaaatccagagcttggagcaggatataaagattataaggattccaatgacaaagtatggattgtcgatgtaaacggcattatccagtaaaattacaacaaataaagtacaaaagattcatccgttcaaacaaaaagaggtcctcacgttcatgcgtgaggacttcttttatgcattctgcaccaattattcgatattttttgtatagcttctataaacttacattttttttatatattttgtacctttttgcgttatattttgaattattttacgttatatattatagaggtgggttgtctttaatctaaaaaaaggaggagaccgatgagagaactgtccgtgtactattgtcctaaatgcggttactatggatactatcagcttcagcggaacgcagtttgccccaagtgcagggaggatatggtaacattatccatcagttatcaggattttatggatctctcctgtgaagcaagggacgaattgctctccgcccacattattgcagcatcttctccctatgtccggcgcctactggcgccacacaaggtcaataacaacagggagattatcgcccgcatgggggatcgcattaccgaattagaaatagaaaatgaaaagctgaataaaactattgaatggatgcaccagacaatctgggagctgatgcgcaagaccaaaggacttgatcccggcagcaacgaaagttccaaaaccggaattgacccctgacagggatactgccgggagtgcccccgcacttcccggccattcctggtcaggccactccatcagcgcttatgtaacgaccgatcagtctgtttagcgtctgatttaaccttttaatcactttatggagtttttcattctcttccataagcctctcattctccatctctataatccttagcctctcagcgtctgtcatatagaaaaccctccttttttctgcttttcttgtaatcactataagccgtttctaactgtttgaaaagcaaaacaaatcgcaatattcgacattattttgtcattcgttaataatttggccatatttttttctaaaaagagactaaaatactacatctatttattttattggaatagggtacaatatgtgcgattgtatattgtcgataaaattgagaggaaaattagcgtttttggaaaatttttgagaagaagtgggaataatatatcacattttttattgcttaggagaggaagatttgtgggaaaggttgatgattggggctatattaagtaagatattgtgattattagcggaaatccttatgggaattatttgcttgataaatgattaaattttatgcttatattgctatgttgtgatctctgcattgtaatctctatgttcatattaccaggcttattgagtaaatattatctattatatattataaacttttgctagatcgttgcagtggatattgcaattttatgctgtcaacggatccgtgagtatcatttgtatgtattaatcaaatctaatgatttgaaatggtttattatttgtgtgatattttaacgaatactaagtttaataataaattacattaaaaatataattcatcaattaattattaaaaattttgattagagtcttgttagcagatcaaggattcccggtggcgtcatatagttaattccacataactcattgccatgtgataaatattttacatatcctgcgtatgtaagaagtatatctattctaatcatattcttcctttgtttttgatattgattgccatatttaccgccatgccgcagataaagtcatctattcaaacagaagtacaatcgaaaaagggttatccgtctttcccccactgcaacttccttctaggccttttggcggaatatttttattctctggatatttttatttcttgatctctcagccgctttctgtcccttggacttagggattgccgaatcagtatgcaagatattcattgttatgggtatcagtatggtaaatacggcggcagggatcattattagtaaagaataaagcgtcttctttacaggcttccgcgccggagcgcggctgcttttgcaaccgtatttccttaacgcagggtgcgcagatttcatcccgggtaagccccagggtgaggatcgaacccgagggtatcccccggagggcttttatatcataggatgcactttcttatgatataaaaagaacaagcgtaaggtcggaccttacgcttgcttttttcaaatcatagatagagtttgattaatttatctttcgatccggactcgcctggaaatatcttccttctctttaggatccggttcttctccaataccaccgaaaggcatttgagcaatcagtaaatagctctctggcaaatcaaacaattcatgcaccttttggtcaataaccgggttataatgctgtaaggaggcaccgatccctaattccctcagcccactccaaatgctgatctggagcattgcactggattgcaccgcccataccggaaagttgtccgcatatagtggaaattgctcctgtagcccttttaccacctcttgatcgtagaaataaaggatcgttcctgctccggctttaaagctgtcgattttttctcttggaacctgcccgccaaaaacatcgtagatagagtcccataataactcctgtttctcttccaaaaccaccacaatccgggagcttttcatattaaatgcatcaggtaccagttctgttaacttctcagtctgccggataacttgactaatctcaacggggagttccttatttatattataatagcttcttcgcttttctaaagattgaataatactcattttgatacctcctggttttattaaaaacacttttatttattatcatatgacatttctttttgtaaaaaggttccttgttctaaatctgcaaaagccttttgcaattcagcttttgtgttcatcacaatgggtcctccccaggctatagcctctcccaaaggcttggaacttacaaacaatatctgggcattttcttcggtgctttttatctccactctgttgccggaagtaagctttgctgctgtcttctctttcacccgttcacctccgataaaaacctctcctgacagagtaaaaatcataaccgatcggtctggctccgtatctataaaaacagaagcgttgggatcgagatggatatcgtaatagtccagaggaagatatttactcatgtatccttttttgtctttgtattgcccggcaagaagtctcaatttcccattctcaaggtcaatctcttcaatctcttcatttttgatgctgtgataggctggggaagtcattttatcctttgaaggcaagttcagccataactgcactccaagcattcgttccgatgacggcagcttctcttcatgcaggattccggaacctgccgtcatccactgaacttctccgtctgaaatggaatcttcatttcccagactgtccctgtggaccatctgcccgcggtatacataactgatggtttcaatgcctctatgagggtgcattggaaatccggctgtgtagtcgtcaggatttatgctgtcaaaggaatccaacatcaatatggggtcgtattcctccgttgtttcatgtcctaataccctgactagcttcactcctgcaccatcctgagttctgaaacctctgatctgtcttttaacctttctctccactgatctcatctccaaacttttttaataagttagccagctgttccttttcttcatcagtccaataggacattaactcaatgattctggcttcgtttcttgggtaaacctggccaatcagctcctgtccctgcgcagtaatatgcagaatgcaccgtctcttatccttggtatctgtttttcttataagataacctcttttttcaagattatttataattaatggcatagtaccgccggagcttagtattttttcctggacctggccaacggtcatatcacctttgtgatacaaagcttccaatacagcaaattggcccagggtaagttggtactctgaaaaaattttggttgactggcggtcaatatagtttatggcccgatggaggccaattaggatttttaattctgtttttgccattgctcctcctatattatctctatgtagttatatattactctgtgtagaggtaaaatgcaagagggtttttttatttatttgaggtttttgatagaaatgctatgtaaatctgtgtattgactaccgacatttttctgcttttgaaaaagtcagacttcgttgttattcaagctgcaaaatagccgcattgcgtctgactaaggcatctgatcttcaattgggcgcatataaacagaatacacagtttcggcgtagtaacaccggtttaggaggcctctgcttaaaactgtatgcgttaacgtaatatgaggcaatgtaccatttatcccccaattatcggctaccagactttagtatcctgcttttgaccatagttttcatatcttcttcatacctttttccgtcaaaatctggattgcctcgttaacccgaactgtatcttctgaatcaattgggtacgatgggcttttccttcctgcaacctttcctccataaaccatctgaacctttattacagaatggaacaccccatcccactcttcgtctcctaatgaaaccttatactgtgttcctatcgggtgcggctttgacgcatccacaagaattgactgtcttggataaaaaacacgtgccatatggaacaactccccctcactcaaaatgttttaacagtttatgatctaataactgattttagcttttcgtctcaatctataaattactatagtaacctatagattttgtgatattttctgcccgttattaacgggcagaccatttttactacttgaaaaatcgaaaaaacttcattgccaatcagaatcaggctagttgaatccattcaaattttaggttacagttttttacgcctttaactttaagcgtctacgcaacttttactggaatccagcataatatatcccactatattttttttcaaatttaagacggtttcaacttccctctctatctccttatgccttgattctttccgggtttctaccagaatgatctcatcgtattccggaattctttgtaatgtcagtacatttctggtcatatctgcgccaaactccagtttaagctcaggaagcctcttctgaagttttatcactaagctttctaaaacttccttttccacggttcccgtaaggaatattgacttgtcttcaagaataaaattatgaatatttacagcaatcatatcgcagactaattcatcaggtatattctcttttccttccaagctatccaacaattcatcaatacgagaaaaagactttttatctcttttctccgtaaatccacctaaaaacttcaagccaaagcgatcctttaaatcgttgtccgtacttaatttaccgttcattacaaagataacgcttattccaaaagcggtcaaaaatgctcccgcaatccaacccagtattccgtattttactcctgcttttaatattgagattttagataacgcaacaggttttgtcggctctactaactcgtccagagcctcctcagcttcttttaagctattatttgtatctgttaaatttttcaccttctgctgttggtaatccgtcaaagactggtctgtaaccacacccacatcctggttcattaatgatatgctatgctgccctaatttttcctgcacctcagactgttcagattctatgctatctataatttcattcagtatctcctcagcacctatttcatccggataagtaatgctcacattaaacatgttgctgtcgtaatccacagtaaccttaatcaactcttttagatatattaaatcaattcccttttgctcagctaaacctgctaaaaatcctccctgctgaatcgcagaggcatatgctttaacgactccgtccgcatagtccactgtcagcaccgtaagtcccatttcctgtgatggctccagcattctgacaaaaacatccaccgatgccgtccctttattataagggtctatctttagaagaatggaattttccttatacttctcctgataggtaatgcttgcagtaagattggcaatgtctctctcatatcctttttttgactgttcgtacttgtccaaatcatttttatactgctcttttaggtctgatacaaactcctcgtttccctgattcatcagttcttttccgcccttatatcctccgagcagaattgcaagtgcgaacgcagtcagcataatgggccgccactttctaagaacagtaaacagcaaatcttttaaattaatctcctgctcataagcattgttattcatctgtcttctcctttaagctataattattccttttgccatacagtaggagtaaagcaaacattatctggatccctttcctgtcaaaaccacccagactgttaaaatcaaaattttgatatcctttaaaatggaccaattatcaatatattgcatatctaattttacaacttcatcaaaatccttgatatcactgcgtccactgatctgccataatccggtaagccccggggtcatgctcaaacggcatttatgttttgcttcataccgttcaaactcgtccaccgtcgggggcctggtgcctactaagctcatatctccccgtaaaacattccaaaactgaggcagctcatcaatactggtatttcgcaggaactttccgatttttgttattcttgggtcatcctccattttgaacatgaggccttttacttcgtttttttgcattagttctttttttctctgctctgcatcctgatacatggagcggaatttataaaaagtaaactttcttccgttttttccaacccgtgtctggccaaagaaaacaggccccggggaattcagcttaatagccggggccacgaagatcgttgctatggcaagcagcagcattccaaccaggcttccggctatgtcaagcatccttttagccactacctgcctcgccgaaaaaatatttctggcaaaagttactactgcatactttccaacacggttcaatacctttttaccacttgacgggatattaaaaatgtcaatattaagatctactatgacccccatgttctcaagctctgatacccactctttcaaagttgtttcatgtataatattgctgtcatttatgaaaacttcatctacattattatggactacgtaatcaagaagagtgtcctgatccgccacgaccggcaaaccacagacagcttctccaatctctgatcgatcagtcaaaacaattccaatcacgatacgattccattcattatatccgatcaggttttctactattgtttcaatttgtccggaggttgtcacaattaacaggcggctgctgtatttactggttttatagattttaatcataaactgcttaaataccactctgaggatacaagtaaaaatgatatttattacaataaaatatccaaaaaccaaacgggataagtcgctgctcctgtgtataaggaataagatgacaacccataatatggaaaataaggtttggttacggattactgccacgaattcttcaaaagttcctcttctaaaaaaatggcgattgttatctgtaagaaaattcatcattccgtacaacaggcttataagggtaatttgccataattgatcgatatgattatatcttccatatagcattccatacctcaagccaaatgctataccactgctgatccagatgacaaaaatatctatgataagaatcaggaaattttccattgcttttctcttttgatacatattctatgctcctatataataaccctgttttattaattattagatatatatgtaaatttatctaatagctcaaagtaacttaattagttcatacaaattagtcatttttttgatgcctataatatatattaacatataccttatttataaacaattacaattttcataagctttattaattcaaaaataaattcctttcgtatttcctgtataccaaaatattttcttaaagcaatgtcttttttcagctggtaaatttcctaaatatgaagattctgatttgagtttttccaaattttcatctgctggttttatgacctttgcaggtgtaccaatagccacagaattgtctggatatcttttgttacaatgctcctgcacccaatactacatcatttcctatagttaactccagaaagaatgagtacgtcgtttccatcattgccgattttaatcggtctactcacctctaagtcgggtattgcttttgataaatgctcactcccccagactacctcaccatatattttcaaatttcctgtaatattcacaccattttttttgcatatccaacaggattactatgacagataattctttcgtaaaatgattgatacaagcgcctcagtccagtacaacacttcatttacaatcctcccgtacctatatcctctctgtcgtttttcattaattacccttcaatttactcagtacccgtacaatactctttttagacgcaaatattactatagctaaaacaagaataacaagataccttatcaatgtagaacgatacagtacattaaaagcaacacacagcataacaacaattgttgatatgaatgcaatcattttcatatcatacaactttttatcatgtatgtgcaccatcacaatcccctgtgatattgccagaacaacaaatgcggctaaggttgtataagacgcagctatataaccatacattggaataaaaacagcatttaagcttatattaatagctgctgcgacaaccgttgaacacataattccaactgactttttatgaaacaataccacgtttgaaaaaatattatatacacaagtcaggaagattccggcagataatggaggtatgatataaatagcttcataatattcttccgtagtcagtatccttacaagttctggtgcaactgccgtaagtccaatacagacaatggcatacagaaatatcataatataagttaacttagtaatatcacgtgtatcttcttcaccgccatgttcaagtttttcatataaatacggtacaaacgcactatttatggagttccagactatcagtgacaaagtactgatagaataaattgttccatagattcctacatcaccttttccgcaataaagtgaaatcatggaacgatctgacacatcaagaatattctttgccaaggtatgcaccatcaatggtgcactcaacttgattccaaaattccagaattctttattaaacattacctttccagttcgaaaaatcttgaaatagcaaaaaagcgcaaatattccggtaatggtatatgttgcaaaaattctgatattacccaaatcatatggttcatcttgaaggatcaataccagaacgaccgcaacgatcgacgcagataaattggaagccaacgtgactaacgccatttttttcgtattatattcatacctttgtctcagcatccacatatccagagcaggcgaaaaaaacaaatatatgaacataaaaatcatcagtgtggtaggtaacataaacagctggttaaggtaactatgaaagagtacatagataaccagacacatactcgaaataatagacgtaagtgtaagaactgatgactgataagcttcgcgtctatcactatattcattcatagcaatataaatggatcccgataccagagataacgaagtaattggagtaagcaccgtcaaccatgatatccatgtcgttaccgttcccatctcttcagtagtcagaagcctcgtaaagacaggaaccgttatgataccaatcccttattgactaaactgacaagaatatatacaacggaagcttttaacacttttgagccactattatttcccattaaaatacctgccaactttaatttattgaaatccattttcccaaattcctgtcataacgttttacaatttttgccggatttccaacagccatacaatattccggtatgtctttaacagcaacactacccgcacccaaaattgagttttttccaatccgaactcctggcaatacatatgccccttgaccaatccagacaccatcctcaatagataccctggaaagtgttaaaagattgtccagataggaaccctctgtattcaaaataccatgattataatcacaaataaaaacatttgacgcaaccaatacatcattgccgataaagacactgttgcaactttgaatggtaaggttcctggttgcgctaaaattgttgccaatggtaatagttcctttaagattttgcttcaatttcccaaatgaatactcattccagcacagcaaataactattctcaccaatcctgcaattatctcctaaaacaaggttagcaggttctttatatttaacagatttgttgatgcctggattctttttccttatcccatatataatccataaatcattccacttatcatgaaccttttttataaaacccattccctatcctctctcatcagaaaatgatttaacccaatccacaaaattatatttacggattatttcttcgtttattttttcaaacggagtattaataaaggaagtcagattatctaaactgtctactccaatcacaaaaatattattactattataaaaatcatagttcatgatatctttattatttgttattaatttcttttcaaaacatatagtttccattgttctaatcgtcaacccgatttgtccgtcttgaacaatatccaataccgcttttgaagataacatcagatttctgtataccctataatctaaatatccttttttcaactcaaacggaaccgtttctgtattattattattatccaagacgtaaaaataattttttacgtcagcagcttttaattggttatagatttctgttaacatgtttactctattttttaaatatcccacaaatattacatcgtattcaaattttactgctttttctttaaatgcattgaaatcataaatcatcggcgaaaatgtaaaaccatacttttcgcaatcgctcttatcaaaagagcagacatgggtaaaggttgatactttcttcagtttcttcacaatgcttatgtctttaaaagttgggttccataagtaaatatgtatattcacattagaattaaactgtcttattatctttacaatggataaggaaaaggcctgatcaaatataatacattcatcacattccttaagtcttaatttccagttaccgagaaaaagcaaatatatcctccacaaaccaaatctttttaacattctttgaaaagtgcggatcactttatttgtctctgctacaaatggttcttcttcgatgtaaatatcatcatcatgtatatcactaaaaaaataatattttttttccggtacgatcacgaatttcttcatgcacggcacttccttttcaacggcattataaatacgattggttaataatggcattggtatattccctctctttgcgcaaatacccataataagccacaaaaaacaacatgatcataaagaaacgcatacacattgtaaattgatagcctatttcaaatagtaaaaaacacacaaataaaaaagttcccctgcccttatccttaatattcattttaatgaaacggtataacccaaaatagaataatccaaccagcaaaattccgcctctaataaaatgaatatattgtccgccgtctgtaagccacaaaccattgatatcacaaatacccatcgggattatgttagtgaatgtgtaataaagtgtgtccgttaaatttccggtagaaccatatctgcctaaaatcccattctctctggaacctaatatctgcattaaagtattaatatttacagcgatcccacaaagtcccacaacaattaatgaaagcgataatatgacgttcttctttgtggttcttcttatccattttacataataatacattgcgatcaaacctgcacacaatacggcagaaacgctcttgcacaggattataattaaaaatattcctgccataagaacataatttaatatactcatttttacctgtgctcggtaatctattaaccaccaaagcataaaatatatatatgcagctatggagtgtgttccaaaaaaagtaacagttttatgaccactccacataaccatataaatatgtggataatgaacgatatagtttgtcttcaacagccgttctataagaccatttcccaagatagtcaaaataccaacggcaattagcaaagaacaaatcatcacaaatagataatctaatatttcacttctacttaatttatcaatttttatattaataagcacacaaaaaggaatataattaagtagatatccatacgagattctggctatgctgcgattaagttggaaatacagtatagtcgatatgaataatattaatacaatacatgacgatataagtagctgctttctatttaaacgcccttcataaaatagaactaataataaaacaaccagatttaaaagataacaattacgtaccatctcatcattaagtgtattccattgatttgatacaggcattagccagactatcatcatgataatcggcaggaaaatacgacttatcttattcataatctactctcatcactattctttctgacatgaatcacttcaatgacttgtgccccttcatcttttcttaccagggaattatccgggatcttatccttaatgatacatcccgcagatatagtacaattattaccaatttcagcaccttttaaaatgatgacattgctgcaaatccaacagttattgcctatcacaacttttccaatactatatggctgctcatttattttctcttcagcataaaatatgtgattatgatcatatatttttactccttcaccaaaaaggcaatcgttccctatggtgatttccccatgcgcattgatagagcaataattattaaagaaggttctcctgcccaccctgacaatcgcatcatcagaaatattaattatcataccttttcgaaacgaaacctgtttctgaagttccaaatacggtccatattccaatgcccaccacgccttttttgacaaagatacaattttaaaatttaatcgttttatacaactaaagaacttcattattttcttcctctcatagcggatgaagcatttactctcaccacttttaaaattgtctcaacttaatgaatgtccaaaaatcattgatttttaagtatttcgttgattttactattatcaccccagacggccttagagtcatatggacgatcagggaattctccatactttagccgaatattatatccactttctttaataaagcgttctactctatcagctaatttttccggctttccagaacaaatattaataattccatttactttatcctgacctgtcgctgccgcaacctggttacagaattcagtgtaatcaataaaatcaaattggttttgacccattgtaaatggaaactccgtttttccttcttcatttgccgctgttactttagaaaaaatagagcttccaaatttcgaatttcctactatataataaccgcgaaaccactgcgcagatacattttgctgtttagcgagcataaaagtcaggctgcgaagtgcatttttactgattccatatggcgtcgtcggattgcatggagtgtctgccttaatgcttccctcaaagaaacctatttcatgcatactgcccattacagcaacacgctttacacctgtctccatcatgtttttcaaaaattcataatgctttggcaactcttcaatatgtgtattcgaataatgaacaaatccatctctccaggccaaatgtaaaagtacctctggtctaccaaaatactcatacggattattcagttcaaacaaattacactcttttctctctgcacgttcatcaatattttgaactttaaagtctgccgcgaccacgctattatcactgtccagaatactttttacaatcccctgtccaaggtatccgtttgcccctgttaccaatatcttcataagatctcctcaacatcacaattttgtgcttattttttcaatgcgttcataaaatactcatggctttccttcgcaatgctgccccatgaatattttttggccagctcaactgcataagtacctttcacttgtaacaagtcaagatttttagcaacgttcttaagaacattcgctatatcttcaaccgtatctgacgctccccagccagcattatataattccacatcttcttttaaattacttccctgcgtcacaacacatggtaatccatatgacaaggcttccaaaacagacattggcataccttcaaatcgcgaagtatggataaagaaatccgaatcaagtaatttttttttcttttcatcgtcaaaaaccggaccatttacgtggactaaatgttccactttattttctttcacaagttcaataatatcctggctggatccagttcgttcatctggaccatacaattcaaatatcaaatggtgttcttctaacacttttttttctttttctatcgccttaataagcagatcaagtcctttttgccatatgctgtatcttccaataaatgtgcctgtatagtcagttttatttctaaaagaaactgtctgctccgggatatctatcccgtttggtataataaaataattacctttaaaatattcaacactatccacttgctcctgtggtgttaaaaattggaccgaaagtgctttttttgcaaaatccgaaaacataataatgcttgcaagcatcttcttaagcttcttattctgaagatattttccagtcatctgacatctcgggataataatataaggaattttattctttaccgcatctcttccaaccttacagcattcaattttaaaaaattcctcaaatacaattaaatccggcttattaaatggttcaggaagacctgacagcctaaagcgttttaacggaatataatggtataaattttcgtcaaacctattgaccgtagaaatttcagttaaattcacccaatacacattatctattttcgcctgtgcttgaacttgttttgggacactatataaaggtccagaatatttccctccctcaagtgccgaaacatataatatattcatttgaccaatctcctcatattgatattgtgaatatcttttagcttttctcgtatatttttctatagccttgcgccattacagcagtattatatttttctaatatgtcttgatatgccaatttaatcatttctcccttattactgtctaatgccgatttgatgcctgcaacaaactcatccatggaattacacacaaatccattctttccattctgtatcacatccctgtttccaatcacattattcaccacacaaatttttttcatatacattgcttcaagaagactcatcggcaagccttcccataatgaagtaaggagaaacacatcagcattcattgaaatcttaagagcatcctgccttatgacccaaccagtaatttcaatgttagacgaaactaactgttctctgagttccccatcaccaatccatatgaattttatttctggtagagcctccgctatttgattaaataactttggatttttttgatggcaaatacgccccaatgtgaacactgtaaaagggtgatttttgtcaattatcattccttctgttaattgatttaattctatgaggtttatgccattatttacataagccgcagtctttgtaagcttcaaggattcctgatgctcaccctcactgcaactaatagtagtacaacttctcttcgcacacaccgcttccacagttttaaaaataactctttttccagatctgtagttttccattaaaaaactatatccatgcggagtgtaaaacaaaggcacgttttttccattaaaagcaaatcttcctattgctccggctttactgctatggaggtgtatgatgtctggccgcacttccctttcaatcttcctgatttcaaaaaaagctttaatatcctttatcggatcaatagcgcggtcaaaatttttaacctgaattaaatttattctattatcaaaataatctctataacctgctggagtttgcggtcttagagcataagcaatgtacatatcataataattaaccaactcatttgccagatctacaatatatgtaaacacgcctccacccatggcctcgactatatacaatattttcttttttccctgatttgccactttgattgttctctcctaactcatatatcaaacatgtcagcctgactacacgttccgtcaatctcttctaaaaacatcacgtgtataaactttttcttccacatcatccagacagctgtcatatctattggcaataattgcataactcattctcttaaacttctctaaatcattaactaccttacttccgaaaaaagtttcgccactttcgagagttggttcgtaaatgatcacggtggctccctttgccttgatacgcttcataatcccctgaatagaactatgacggaagttatcggaattactcttcatggttagtctgtacacaccaactaccacttccttttctttcgccctactccagacatcatttgcttcatatgtaccagcgatttccaatactctatctgcaataaaatcttttcttgttctattgctttccactattgcagacatcatactctgaggaacagccccatagttcgccaataattgtttggtatcctttggcagacagtatccaccatacccaaaggacggattgttataatgagagccaatacggggatctaaacacacgccattgatgatctgccgtgtatctaaacctttcatttcagcatatgtatccagttcattgaaataacttattctcaatgcaaggtaagtattggcaaataatttaactgcctccgcctccgtaaatcccatgaacagtgtgtcaatattttccttaattgcaccttcttgtaataatcccgcaaaaatctccgccttatctctcattgcctcatcacaaccaacaataatacgagaaggatataagttatcataaagagcctttgactcccttaaaaattccggactaaacatgatcttatctgttcccatttttcttcttacactttctgtatatccaactgggatagtcgacttaataaccatagttgcttccgggttatatttcataactaacttaataacagcttccaccacgcttgtatcaaagaagttcttcttactgtcataattagtcggtgccgcaatcacaacaaattcagcattcttataagctgatttcgaatccagagttgcccttaaatccaattgcttctgttccagatatttttcaatatattcatcctgaacaggactctttctattgttaataagctcaaccctctccggaattatatccacagctgtcacatggtgatgctgtgcgagcaaagtcgcaatagacagtccaacatatccagtaccagctacggcaatgttatatctcttttccataatgtattatctcctcaattacatataaaactctttgtaccactcagcaaacttacgcagcccgtcacgcagtgatgtagacggtttgaatccaaagtctcgttccagcgcgcttgtatccgcatacgtcactggtacatctcccggctgcatagctaccagttccttatgagcctcaaagtcataatcttctggtaacacaccggctctaatcagttcctcctgtaatatcatcacaaaatccaacagactctctggatggttacttccaatgttgtaaatattgtatggaggaagtggcaatccatcttccccagcaaccttatccggggctttctgcattacctttataacaccctctacaatatcatctacatatgtaaaatctcgcatgcagttcccataattaaaaatttggattgtctgtccagcaagtaatttatcagtgaatccaaaatatgccatatccgggcgtccggccggtccatataccgtaaaaaatctaagccctgtcgaaggaatgttataaagctttgaatatgcatgcgccattaattcatttgatttttttgttgccgcatataaactgaccggattatccaccttatcctccgtagagtaagggacttttttatttgagccataaacagatgaacttgaagcatatactaaatgctcaactggataatttctacatccttctaaaatattgtaaaaaccaactaaattagattccatataggcatctggatttgttatagaataccttacacctgcctgcgcagcaagatttacaacaatctgaggtttaaacttttcaaatattgacgtaataacggatttatccgcaagattgcctttaacaaacatgaaacagctatgatctaataagctttttagccttgcttcctttaaccgcacatcataataatcgttcatactatcaagcccgataatgtgaacaccttcaacactggagagcagtttttcagccaaattggaaccaataaaacctgcgacaccagttaccaataccgtcttatttttcaaatcaattttctgcatattaattgcctctttttatactttagaatattttcaacaaatatatttatattatacagactcatttttacaaataactcataattgttagatttcacaaactatttatgctcttataaaattttaacacgatcaagataaaatcgcaactgcttaagattatattaagaaaattgagtatttcttctcataccgcaagctaacaatacatatgcaaacggattataagccacatccaaaatatgatgtgcaattacacaattcagcgagattataacaactgcaaaaagaaaatatatatcgtctttatgtttatagcagcaatatatataaattattaataatgcaatagtaaatattaaaccaaatctaagaagtagatgaatataagaattatcaataaaaaaataatcagccggtaattgagcagttccacccgcaccaatcatatcaactggctggccccataaccggattgaatacatatccaaaccggttttccctagctgtattctggatgatattatcttgtcaataaagaccaacactttattttcttcttgataagacactgtagcaacaaaggaaaccagagtaaataaaggcatactcaccaaaccaaattctttccaaaaacacttccatttcgttaacaccccatttttatcatagggaaatctatgcagccactgattaatgccaaaaataatcacaattaaaagcatgcttatacaatccaaacgtgttctacaaaaataatagaccacacctgttatgattataatacccgcaaaatgataagttttcaaccgctctgccttcaaatagcagaacaccagaatcatataaaaaatatgtgaagcaaaatccgttacataaacacttccaaatgcaatacgtactcctctgccatcagatttatagataagattctcaatcacccccaagagagctgcacataatgccaaaaccattattgaacctgcaataaccagatagacttttaaaattttttcaaatgaaatatctttacaacctgttagaagcaaaaccccaaaaaaaggattcagatatccactatttaaatatatcagaattgtgcatccaaatccaattatcaaaccaatatactccccggcagagtatgtgtcataaaaaagtattttcaatccaacaaaaaatatggtcagaagtaaacacacctgactaaaacctgtattaagaggaagcatggttgtttcccacattccccgactaagataaataatgaatcctgcaaaaaaaagcccttcttttgaacagattgtattgacatattgttttaaacctgttattttatgcttcattataaactcctgaccaccttattctacaactacatatcccagaatctttactccaaacttttcacacaccccaatctgttcacttatctgcgaataagaagtcttacccgcctgtacaatcataatactatatttcgcattaatcatattccttaattctccagcatcatcattcacacatcccccagtatcaaccgacaaatctagctgactaatcctgtctttatagtctccaaccaccttttttgccaattcatcttcgcttaacgcattaatgaatattcctgacatctgatattgctctgaccaaagttgtatatctaaggcggtccggtctaaggatggaagatacccctttgcagaactataagtggcgataaccggcagattagcactaagcaggtcctccttcgatttcaaagaattgcccagaatatatttaattgaataaaagcaccataagatcagtattccaaaaactgcacctgtcactgcaaatttcattccttctttgaatggattaaccggagctattgcattaatttttgtttcatttttctcaatgtatgaacttttaccatttacctgagaaattcttttattctccaaatcaaccttgttgttcaaaaaattcttcaaattattcgtattactattttgtgtattcgcaacattcacatcagccttcgtaaaactcgatgagcttatttcttgaatcgtaaatgctccctgggtcttagctattacaggtgtctgttcatcaataagcttttcaatcgactccaaaagctttttagcctgatcttcgtcttgatgataaaccgtaatattcaaaatattgcttcctgttgaacacattattatttctttcaaatatctggcatctacatcaccgtactcttctgataaaccacttaacaggccccttcatttataaaataagtaaatgagttcaggacattgcccgtaccaccagtattggatatggcaaattgagcagaagctgcataaatattctggtaatctaatttcatatagatcgagtgatctacatattcctgtaattggtcaatttgcttttgaaccagttccaggctttggtccagctccgatatggtattatcataatcagcaattgtattctgataatcctgaaccttcttttcctgctcttcagaaagctgcgcaccgtctgctcccttttgatagcctacagctgcaaacaccaaagcagacaacagcacaaaagcaagcaacagcttttttcttttcatgatttctccatatatatttctgagatagatggatttgatttgcttcaaaataaacctccttcattagctccagtttagccgggaaaatttgattttctatttacagccttctgcattattcttacaaagcctctcttcatttcaagaatcagtggttccttaaaagcgatcagtaccagtatataacacccaaaaaacaaaacagaagaaataattaatttaaaaaagtcaatgaatggaaatgacttgacccacaaggaaacggcactccctaaagtaagcgcaattaaaaccggtatatacttcagctttttatacatctctgccacaaccttttttagtgccgtatattgtacaatccataccacaacttccgctgccagagtacctattgccgcgccacatgaggccattcgtggaattaggatgaaattaattgccagattgacgcatgcgcccgcaatttctgaataaagtacaattttctccttcccattggtattaacatttgtatccccataatattcgttagtccaattaacaataatgttggcataataatctgcatcggtaatatagaagcttcaaattcctttcctgacagaaataaaatcccttcttttgcaaaatatataaaataagtcatgacaggcatagcaacaagtatgacaaaatgtacagcctttctagctaaacgtataaactctgcattcatcccttgttccacgtaataagaagctctgggaagcataaccgcacctaatgatgtaataacactgactaaaattgtttttatttttattgctgcattatagtatcctacttcaatattaccattcaaaaagcccagcataactacgtctaaatttgtgtatattgtcgccgcacaagacatggcaaagaaaatacacaccggctttatgtgttgtttcatatggtagtgtcctaccggcttcactgtaacgtatttatgtgcatgtataaaatttaaaacgttagacgctgagcccgcaaatattgaaatagcagcataaatttcataatcactttgctgatggattaacaagaatgtagcaactaatgcaataaacttaaagataattgacctgactgttatataagcatactgttccagacctttatagagccattctacacctatggcattaaatattatggttaagctggttataataaataacgtcttctcttctctgaactggggaaccaggtacaaagagcatgcaaatataaaatacacccaaaggctcattattaaatttatgataaacaattcgtgtacggttcgagacaattcttccttattatttctcactttagcacaagctcttataccataagtggggatacccagttgagaaagcattgaaaaatatgcgacaactgatgcaacaaaggatactttgccatttccttcggggagcagaattctggatacatatggaaacgtaatcagcggaaatataattgatgacacagtaagcaatgaattcattataaaattaaactttaatgatctttccttttgcatttatcatatttcctcattcttccatccaggtttatatactggatcaatgccaaatttcccttttatagcatctgaaaaggcctttttcaatattataatttccactactctttttttcattatcgaaaagaaaactatttttaccattactctcaacgcaaaatacgcaaagcactgcctcggcatatgtctccgatacatatcagtcatatttcggaagccataatacgttttccaggtcaccccgtgttcacctctgccaacatcatgatgaatccggatgtcaggaacacatataattctccccgccttacttaatcgaaggctgtgctccgtatcatcccaccagatgaaatattcctttaaggtaacaccaactttcttcatcttattacggttgatgatcgttcctacatatgaaaatgcatttatttcaaattcttcctttgcatactcttcttcaggtaccggctgctcaaaaatgcgaaatcctctgctggtataatttttcctgtgatttgtatcaatcgttccattatttattacttgcccgcaaatcgcagatatttcatccaagtgctcttctttctcttctagatagccatgagcattttccagcgcattgatttccggcattgcatcgtcatccgatacccatacccattccgcagacatggacaggcttttcttaagtccttcatgaaatcctccgcttccgccgatattttctaccagattcagcactattttttcaaagccttccttttttctttgccacgactccaaaaacgctgccgtctgatcagtgctggcattattgacaatcatcacatataacgggcttttcgtctgtttggaaaacaggtccagtgtttccatcaatttttctattcgattatacgttacaataacaacgccaatgtccatagtcacctcataaaatcatagctttctgtttgttttatacatcttcccattcaaaaaatcgtatattccccatgcaatataccttattttcatgccatatctaatgcaataataacagtacatcacgagagtgtgaatatagggaattattttactgctgcccttatagtatttcttaataaaaaaatacttatttcttaccatataatattgagtggtacccgacattttctcagttttagatgtactgctgctcaccttatggtaaataacagctttcggcacataaaaaagccttatccctttctgctgcagacgttgacagtaatcagtatcctcttcatatagaaagtaactttcgtcaagtaatcctatatcacgtaccactggagccgggatacacatgcaacaaccgcttatgaacgaaacctccaccggctgatcctggatcggcttccacagggttcccattcccgcctgtgatactttagcagtccttaaatcgtaatatccgcctgcataccacactttttctttatcgtctgcataaagaatggtactggtccgtactgagccctcaggaatatccgccgcttccatcattaaatctttcagaaaatctggttccaccagtgtatcattgttaagaagaaggatatactcaactcccaattccaaagccagatggatgccagcattgtttccggcagaaaagcctctgttttcagtcagctccaatagttcaaaatcatttttcttttttttatcacgcaatgaacttaaggaataatctgagcttccattatcaactacaataattttgtaattgctgtacgtcatttctttcagactggcgatacattctatagtatctgcggcgccattatagttcactaatacgattccaacgaatgcctctttcatcgttcactcttcattctttctcatataagcattttaaaattttttcgctttttacccagctgaaattcctttttacatattcccgacttaaacgggatagctccagacattttttctcatccttaaccagcttcaacactttgtcaatatactcttcatccgtctctgccagtgaaattacctcgccgtcttcatcgatgccttccgctcctacccttcccgtaacgaccggaactccgagagccagactccttaatacctttaccttaattcctgctcctaaagttaatggaaatacagccacctgtgctttccgcatatattcatccacatcttcaacaaatcctgttatatgaataaattcattttgctctttttttaatgcctctgacggctgattacctataatataaatatttaattcagggattattttttttagtatatacccaattcttatgagtctttgcgccgccaaataattttcttccctgcccatctggcccaaaaagcagatatttgcatactccacatccctttttttttctgatggctttgaatgaacatcctcgattccataatagggattaagtacacgtattttttcgatgcggtataaatcttttaacagtctgcaatctttttcattaaatgtaagtacctcatccgcacttctgcagtagcgtccctcccacaatcttactttcttgtattcccattcatagtacaggcgcttgaggcctctgctgccctctttttttctcacatatgactggaccgtaatatcatgcgctattaaatgaacctttaccaggggaaatatcttctttatcagccctatatactgacccatggatgaatattcagcatgaaccgcctcaatatgatacctttttatatagtaaatcagttttgctgcaaatcgaaaagaggttcttgctgcaaaataagccggtaaaaatggctccaacattacatgtaatgcccgattccatttatgaatgataacataccagcagtgttctcttttctctgaagcagccaatattttatcgtaattagaagcaacaaatgtcagaatatatacgttatgattcttttcaaggctttcaatttctttccccatacataccccgccggcatgattcgtctccagagaagggtaatagggcgagatgtgcagtatattcatcctgatctctcctgtattctctcaactatttccaggcacttttccatggaattcatataagcatcttttgaaaaattctgcagataacactgacggactgtctctttagattcttttcctatcacattttccgcaattttctgtgcggccgtatctatattttcataattacaattataccctataccattatcttcaaccagctgccaggtatcacccttaatattattaatcagactcaatcccgcatataagtaatccacagacttcattgtaatacctacacaaacggaattcttcatgatattcaacccgtaatcacaatccgccattactttcatcttttctgactcttcatatataggaccgtaaaaggccgtatcaatcccagatgaatccaacgcattcgttaattcttctctgctttctccatcgccaatgatactgagcttaactgttttgtgcttttgtatacacaccagcagctttaccataaaatcaatatcaataatatgattaattgatcccaaatagcagatatgaactttttcgtcatactctctcgcatgcaaatcaaccatctcttccgtttcccgtggccagtatacatttaatacaggcatctgaataagatgatctttcaatacttcttgatataatgtacattctgttataattaaatctgcatattttaaattgtcgtttcttagtttcatccatatactgaatggccatatcttttttgcatagttaaaaggaagagattcaggccacaaatcaagaatatcaataattagccctttatgatactttctcttaagtaatgccatatattttgccagcgaattcgccggtaccagcacataaataatatcaaaatctatatgttttaaataggcataaactttttttgagaaatcgtaatgagaatacagccttttcaaagatagattttgtttataaggaatcgtatctataaatacggtgttattaatcggcagacgaccttttcttttttctctatgaatgaaatccgataaaatcaaacaaacctgatacccctggcttgcaaaaaaatccgagaccatttgcacacgaggttcgtagctggaggaattggtaataattgcaatcttcatagcttctcttttctgaccatttattcctggctttcattgctttttgctgaaataactgtatcattcgtttcactgataatcttagtagcggcctctgccgaaaagccttccgtactttccttcatgaatagaatcttgattgtcttaaagatgatttctatatcctgtaaaaatgaatagttttgaatgtacatcaaatccaacttgagcttatcgtatgctgacgtattatacttgccatacacctgcgcaaatccagtcagcccaccctttaccttcattcggtatctaaactccggtatctcctctgtataaagtattacatgctcaatacgctccggcctgggtcctacaaggctcatatcgcccttgatgacattaaagagctgcggcagttcatcaatgcggtatttacggataaatgcgcctacaggcgtaatcctggggtcactgtccgtggccggaattgagatccctctttttctgcatctacaatcatactcctgaatttacagatagaaaaaacctttccatcctttgtacaacggtcctgaaagaatagcaccggacctttatcatataattttattgccaaagcagttatcagcattataggcgaaagtaagacagccgcagaaacagataatattaaatccactattcttttgataaaacgctgttcaaatgtcagtccgtcatttctcgctaaaattaacggcgtatcaaaaaaatgcaggctttccgcgctccggattataatatcagatatcttgggcgtagcgtatacccttatggattctccatagcaaaacttgagaatagaattgcggatatgagatggaatatcacatatgacaacgccttcatattcttttattttcttccgaatcactttttctcctacggaaatatgcaaagactcaccgatggcaaaccggtctgtcctgtcatttattttgtccataaatacggatatcgggcgctctccgtataccaacaacacttttctgggtggatacaaggtccggtataacttaattgcaagaaagctccagactgcaataacaaaaaaatccgcgaccgtcatccaaaataatggaatgatcgattgaaaatgctttgttagtaatactatgggaatatacataagtccattggtgcagatcgaggccagggtctgggcatacactgcttcatatgttttcatataaccaagctttaacgccccatacatattactgaatacaaaaagggcaaaggcatatacagttgctataaaataatgccctaagcgcacatatggccattccatcttaggattataaaaattaacccacacataggcaaataacagcatttctatcgctatcagaaccatgccggcagcaaaacgaaccaaccttttgtactgttcataattactcatcttattcctctaatcttctgacacaacatttctgcttcctgctaccccaaccgctattaatacgataaatactggtgtcgttattggtatactaatgtttacaactgcttgcactgcatagcaaatcattgcaaacagtatagccatcacatatgaatcttttattgcatttttaaccatctgaattcctgcaccgactaaaatcaatacataagatgccaggccgaaaggtcccattgtaataaaatattgtaaatattcattatgagcactatcaaaatattcgttatactttgctaacgattcggcatatctccctgacgataaaatcataaccccaaaggtgtccggaccatagccaaatatcttatggattaaaggctgctttccataacattcaagaccaattttccatatataacctctatgggtaccccactcatcattaaaaaccaaataatctcccagtgccccatagcgttctccgtgccctgcaatattggcgtcatataagacatacagcccacataaaaataatgctgccaggaaaatggcccaggaaacttgcagctttattccgtattcaccattactctttcgggtaaaatcatacaaataaatgatgcaacagataatagtagctgcaaccacaatatactctaatttactgtaaccagaaagtttttctaaaatgccgctcatttgcagcacatgatttggcattactttatttacaaagtctaccacataaataacatataaaaatgtagtcagagtaagaatgtatctcttcacgccaattctatttttaaacaaccatattggtaaaaaagcaaataaggctccaatagctaagtaagcattatcactaaggcccataataattgcaaaaaacgaaattatcatacaagcaaaataccaaattgtcttagataacgacttcgcacttacaaataaaactgttgatattcccatgaccatagcgacatatgcagtatatgtatttatattaccaattgtagatgcaaacatattatattgattactagctatgtttttcttaaatccaaatatatcaagcataaaataatctgtaataccaaacaaacatacaagcattgaagcaaataaaaacagttcaactaaccatttgctataacgaactcctttgctaatcataaaatacaccagaccatagattaacaaaagaaacagtcctgaacatctgccctcatttccccataacgactcatatttataatcggattgcaaagttgagatagtagcaattatacaaaaaaaaatcattcctttatctgtcaagttaaagcgactaaaataggtaatctttattaacttcctaatgttaccatcacgaattatcatacacgtaattaatagtagtaaaataacggccattgaaatcacagttatataaaagaatttgtattttactactaaaatatcaaaataatagtcatgataatataaagggaatattgttaataacaagactgtaaatatagcaattgcattaccaatcaattttatttcactatttaaggccacaccattatcgatattattttctgacattactccatctccactttttattgtttataattagtatatcaaccttctaacagtatatcatctactataagataacgcaacttcatgaatatggaaaaaggcagtcttattcttacactttctttaaacatcttatagctttcctactttttctttaatattcttttatagcttcaatcatcaaactatctactccggaactaacccaactactcttaaccagtcgtgtttaggtgtatacacctaaatattaatatctcgtaaatcttaagattgatatttatacgtttcgcaacaaatagagtatataatggtctcgtcacaaagctaaaccatcttttttacagttatatatccgcctagtttgaggaactttacgataaaaatcttattacaactaaggtatatataagggtcatcttcccgttattagtctcacccaaccttcggtatggaacctcattatgcagaattactttacgacatctgcaaacggaactcgaaagcaagtaacaaaaagaggacaaaatctggactggtaatatcaagaatcttagtattacagaatttgtgaaatgcttcagagcattccagttctgaaagaaaagaaattctctacacctacaaatacgatatctatagcaaggagggtcgcatcatcgagttaaaagcattaaagaaggtttccatatgaatccaaaatttaaatggcccagatactccattttgtatcataagaaagacacgggtgaggctgaagcttatttgacaccctaaatagaacatgatatattcagcattgtctaccggaccaaggccattgttcagaaataccttcagatatttttactggttcaatcaataagtaaaactttttcctgtctctgattttggcgacacttgattttgattggctcttatccactcaaatagacctcaaccagtgcttttgttactaaactgacactgactgaccagctcctccggggacaggcctgcaaatgcctcttccagtttaaagattgcttcaatctactccagcgtctgataagcaaacgtgtcctttgctttttctttgcttagtgacttgacggtatcagcaaaacgacggcgggtgcgagaccaacagcctgcgatctctaaattctcccgttcgttttccagggtgtggtatacctgatacccatctgtcacacaggtccccttataccctttgaggaattccctcggttgaccggcgtttcgggtcttttgatactcgtacagaacactgggcagtgagtcatatagtttccccgaccaatacacccacatataactcttggagccagcctttcttccacctttattgaccagggcgggggctcatctgcctgaatgaccgggcagctgcatatttccctatgaatacggtcataaaacaaagacaggtaacgttctgcacactgaatggtccagtttgccacagcgtgcccccttgggtatgttctgccgggatagatggacctcattgcgggcaaattcctgcattaattggtacagaggaatggcattcacgtatttcgagttcatgatggcagtttctaaagacggagccacgacgctgttccggagaaggtcatgagggcgtttttcctttaccatggtctcattgtcctttccgacataaactgctacatggtgttccagtactttaaaagtttttgggtgaaaatccagacgcttataaacttcatccgacagtcatttccaaccgtctttgcagaagatctgctccagctgttcttcactcagctcatgcagaacctccacggtctcaatgccttttgaatctttctctcgttttcccttctgtttacggcgtttataggttcagggagaaattccctctatctccggtccacagtcgtcacctgatcggcaatgacccccgcctcattaaaacaatcgttcatgcttaactgccatcgattttcagcctatcactggaacgtccgaaacgtttctggttcgcaagggaaagctgttcaatcagaagctccacgttccggttcagctggcccatctgctcctgcatggataaaaagagctgcacaagcacctctttactgcattgattcagttgtacttctgtaaatgtgttggccatgtccgtccactcctgattatgatggctttattatactatacaaagtagaaaaagcgaatctaagaatcagaaggtatcaaggaaaggagaaaagtcaaggcatcctcttgttgataaacggctttcttaaaagaaagtacgtttttcgtccccaaactttttctctgttttgcgcaaactcataaaggtctctttcgctaaatccccttgatcctctgcgccgtttaatagacagcccctacatcagccaggtgtactgttctggagtaatagcaaggacttactgctcattgcggggccactggaagcggccggcctccagcctcttataaagaagtaaaaatccatcctgttcccataagagtcctttgatccggtcagttctgcgtccgcaaaaaaggaacagaatgcccgtctgaaatggatcgaggaggaactgttttttaacctgggcggaaagaccgtcaatttcccagcgcagatccgtataaccgcaagcaaggaataccttgtaacctccaccagcatcattaagcatgttgcacgagctggatcagtttttccagcagctctactgaaatcaagttccttacttcgatggaatagtcacaaagcacagcacagcatccagtccatttgagtttcccgcagatgatacggtgggaggcttggcaatgactggggcaggcctggcggacacggcgtagccgataatagtagttggcttttgtgataccatgatcatggcaccaggcagctacagatacatctttcaggcgcatctggtattcatggatatcggcatcccattgctgaatgcggtatacctcagtaatcatactggttgtggaattcattgggatcctcctgaccagtattaaaaggtcaggactcaacttttaataccaagtaataataattgagttcattatctcaaaatggtcaggaaggatagtgtcaattttgaataatatagttcttttattaaacttcagattctttccttcaataaaaaactccaaatactgagaataaaatattcatcagaatttgaagtttatgattactttcctgcgataacacatctatagaccttgcacccccaaaacttattaaaagccagaatataggtgtgacaataggaagttgatatttacaatggcctgaatactatacatataatgccataatatatggtgactatctttgcaataaagacatctccttacattttcaaatataaaaactaaataagatatcaaacccgcaagtccaaccgtgattaaaatatgatgatattcattatatgcactttcacataattgattatagagattatttgcagttttttgatttactaaaataccaaaggtttcaggccctaatcccacaattaatgtgttacaactgaataattaaaaagatggaaataccatttctgtgttatattctaattgccaaaccaaagcagaaacaaaagaaggtatctccacatggctagtataacgcaagatatgagatttcgtccatcactccttaactatgcaaaaaaacatggagtctctaaggattccatcaagtacaagaccaatcgacagtatatctcccctggaatcagcgctttgacgctccattgagtccctcagagagcactccaggcaaccacttcatcatcccaaccaacattcccttgaggaaatcaagttgattctggatatacgtaagcacaatcctcatgctagcctagttgttttctgggtgaaacttatgcagtggggatattcatgctcaattcctggcttatattgattcctcaaaaaacagggcagtggctattaagcctcctaacctgcccgatttaaatacattcagaccgacaatggctcggaatttacgactctcaggaagaaaccgaccctgtttcaggttcatatagaacagcataccataacttataagctgatcccgtcatttacacccggtataatggcaaggttgaatgaagccaccgcaaggacaatgagcgtctcaatgccacccatacattttatagctttcaagattttgctaagaaactaaagctatacaacaataggagctatactgcattcctataccccaactattggcaaagaacctataacacatattcaagattcaaaaaggagttgcacactggctgaacgaattcagcagtgtgcaactccttaaattaatcactaatttgcaataagatacaattagtcttctacgaatacgtaattaatcttctcaccagtctggttgtagcaacgatcattaccatctttagccttagatttgctcttctgtacgctaccgctggtatttactaacttgtagctgatcttagcagcagctgctgcatcattatcaacttcataatattcagtccaatcttttccacttggaactcctggtgtcgttacatagtcctcatcaacgaaatcatctgttgtcaagattgaatatttaggtgtggcctctgactcatcaatctttataactgcatatttatcatctttcgctgcacttaaaagcattcctgataagtaatatttgctgttatcaacaccagtcttaccagcgcccttatagctaccagatttattgaacaagaagttgaaagactcgccatcgatggaaacagtctgcttgttggtcttcatagagccatcatcgcctgaaccaaagtaatagcagtaatattcttcacttaacagtttattagcactttccttaaagttatcttctgtatcaaactttgcatcgctgcgggtatcatcagctaaaagtgattcaatcttagttgtgcttccatcttcaaatttgataaatttcagaccatctttcattctaccataggtatcgaatgcatatttcttaccattgatagtcttgatctcagaagccactaacttaccgtctttatcagaatagtaccaagcatcttcatcatcatcatacttgccttcatacagattctcatccggtacaactttgaaccagcccttggttactctagcaccatcttctggtgtaccataatatctccagtttctggtgtaatcagcagtaccctggctagctgttgcagttgttggtgtagcatcataaactatccattctgcattcatacggccatattcatcaaagctgtattttttgccgttgatggtcttgcccttctcgtcagtcagcttcttgccattactcttgaagtagaaccaacgtgtctgattctcatcatcaaaaacattgctgctggactgacccgctgaatctgtctcatagttattatctacgatatcaagataaacccagccaaccgtctgtgcaccgtcgttctcgtctccgcaatagtaatcgccttcctgccaagcttcgtcgccagtctttctctcgccatctgtaccaatccaaccgaataacatctttccttcatcattaaagagatatttctttccgttgatagtcttgaaagtagcgttgctgctgctgctggaactcttataagctttaccgttggatccaaaatagtaccagttatttactggttcatcttcgtcatctccatcgtaatcttcgttctcaacagaaacccacttattggttgacatagcaccgttctcatctacatagtagtagttgtcgttgtattcaacgacagcatcggtagccatttcgccatcttcgtttaagtagaaccagttatctcctgatttctcccacttttctgtctctaagtcgccgttcttgtcatagtacacccatgtaccgttttcttcctgccagcctgttgctgcgaaagaggacatggaagcgcctaatgcaagcagtgctgctgtagataaaacagcaactaatttggtctgctttctcataattaatgcactctccttttttctttttgaaatactttttcgaaattcctaattgcattacgaggtaattatacttcctataatggaaattatcaataccttttttactttttttgcattttttgcaaaaagaaaaaaatatttacatttcctccagaagctatcaattcctccatcacatggaatagtataatacattttttaggaaaatgctataacatttctctgttcattttcttacataatcattacgaaaattattttttgtaacaaaattgtatttttataagtacaatcctgtttttaaaggcttattctgagatattccctttcataaaatactattaagaacggagtccagccgttagatgcaaagctttttccagacagtaaccggccacttccttttctatataacagcccctatacccaacaaagtcaaactatatatcagattaaaccatatcatcataatacctcatcaaagacctgttcccaggtcacacctacagtctattagcaaattaaattatcaaaatctatcatcacactctcctgtcacaatcctctttcgaacctttctatcacagtcttctttcacaatcacataataatcttccatctataatcccctattgcaatttaccattccaatggtataatgttcatatatttacaataatcgctacatttgaacattctacattaacacccttatacaaactataacctatacggaggtcaatcaactatggatcgtaacgtcatcatctgccgttccattctggaaaacccggcagttacgcagagagatttatcaaaagagcttagcgtttcccttggaaccgttaataacctgataaaagaatgcattgagaaaaattacattgagattggaagcggaagcgacgcctatgagctgctgccagcaggacaggccctgctaaatgaaaataaagtggacggcgcactcatcattgctgccggttttggctcccgctttgttcccttaacctttgaaactcccaaaggactgctggaggtattcggagaacgcatgattgaacgtcagatccgccagctgcacgaagcaggaatcaggaacattaccattgtagtgggctatttaaaagagaaattcgaataccttatagacaaatatcaggttaagcttctatataatcctgaatattcccataaaaacaccctgaccaccatttaccatgcccgagagatccttcggggtaaaaatatgtatgttctctcttctgataactggatgcgccataacatgtatcatgcctatgaaaccggcgcctggtattccgcatcctttatggaaggtgaaacctcagaatggtgccttgattataataagaagggacgcattttaaatgtatccatcggcgggcaggacaaatgggtaatgtatggcccggtctttttctccaaatccttttcagaacagttcttaaccgtgttggaaaattattacaatcttcctggaacagagcagttttactgggaaaatgtctacatggaaatgctgtcaggagaagctgccaaaagacttcctcatattccggaaacaagacaggacattgacctgtttatcaaccgaagaccggctgacgaggtatatgaattcgaaaacctggaagaacttcgccgtttcgatttgaaatatcagcgccattccgataatgaagccatggaattagtatcagccgtatttcaggtgcctgagtctgaaatcacagaaatacgctgcttaaagtcaggcatgacaaacaaatcctttctttttaaaataaaggaccgccattatatctgccgcatccctggacccggaacagaactccttattaaccgtcagcaggagaaagccgtttatgatgccctgaacggactggatatctcggaaaaggtcatttactttaatggagaaacaggatataaaattgcggaattttatgaaggtgcccacaatgcggatccttccaacagggaagaaataaaacgctgcatggcagttgtccggaagttccacaaatccgggcttaaggtagaccactcctttgacattcgtgagcggatcgatttctatgaaaagctttgtaaagcccatggggacatcctgtttgacgattacgccattgtccgtaaacagatgacagagcttttaaaccagctggacagcctggggcatgagaaggtcctttcccatattgatacggtggtggacaactttttaatgcttccaaacggcaatatacgattaattgactgggaatattccgggatgtgcgatcccctggtggatatcagtatgtgtgcgatttattcctattatgacgaagaacaggcggatgacctcataaagatctacctggaacgggagccttctgatgaagagcgtttcaccatttacgcctatatggccctgggcggtttcctgtggagcctttgggcggtatacaaagcagccttaggtgaggaatttggcgaatacaccataatcatgtaccgatatgcaaaaaactactataaaaagtgctctgaaatctccaaaatatgatatttttggaaattgtccgcaaatcgtaataaaatgtttatgtattcctgtcggtactatgctataatgtacacgaatgcaatgagcagtgcgaaataaggcagggaaagattttcgttgtgcttgcacataagaaaatcttttcatggcttatttcatagggcgaatgcccgtgagcgagtaaaacctgcggttttactcgctgcactgcggacttatgaaataaggcaagggaagattttgttattcctacatataatagaatccttccatgacctatttcacagggcaaatgcccgtgagctcgtaaaactgcaggttttgcaagccacactacggatccgcgaaattagacaaagaaagatttttcttattcctagacttaagataatccttctgcgacttatatcacaaggcgaatgcccatgagctcgtaaacctgcggttttactcgctgcactgcggacccaagaaataagaaaaataaaatggctagaacaggaggatagacggtgtgcgatacagaaaaaatttaacagctctgctgatagcagggcttgtaggaaccgctgctctgataccggctggtacagcctggggggccaccggctgggttgcagacggttcccagtggaaatatgttgatgaggatggttccattcataaaggctgggtaaagacatccgacggaaccttttattttcttgacctctccacaggctatatggctaccgggtggaaacagatcaacggaaactggtactattttcattccaacggtgccatggctaccaaatggatacaagacggcggaaaatattattacctcatggatgacacaggcgtccttgtaaagggctggttaaaaataggcaatgactactactacatgaagggcgacggttccatgtccatcggatggcgtgaaatggacggcggctggtattattttaaagaaaacggtaaatgtaccattggttggggacagattggaaacgactggttttatttcggctctgacggcaagatggtcaccggttggaaacagattgacaatgcctactattatctcaatgtggattccaaatccgtattaggcaagatgatgaccggctggctcagtgacggaaccaacaaatattacatggatgcaagcagcggaaaaatggcccatggctggaagcaaattgacggttcctggtattattttaacgattccgggcatatgatgaccggctgggtacagctttccggcgtttactattatcttgatccttctacaggcaagatggcggccaacaccacccttaccattgatggcaagagctatacctttggttccagcggagcttatcaggaaaacgcttccggttcaccttccggaacttccggaggaagcactcccggaggtacatcaactgatacgaccactgctcccggcggaaccacttcaaacacatcggactccagcggaccaggaggatcctcttctgacggcaacaccttaagcggagcaccgggaagctcctcaaacgatactcccggcggttcaaccactccttcaggcagcaacgggtatcagctgtcgccagggcttacgtcaggccccggttgatctcatatgacttagtatctgtgtgggtatctgcacctcggcgcggatacccctttatttatgtgcgcaaagagtcaggccgggaaaccatctggtcctgccgcaaaaaccaaggaaagtttcaaagcaggcaagcttcaccttatttataggcctgtatttttccttccaaaagcataaaagcgcacggtaatttatagtactcgaatgataaggaggtatcacattgagacacaaaaaaattggcatacgttttgccgcagcagcattatgcgcctttatgggaatgtctgctggatttggtccggccatggattcctgggcagcgggctatgaaaaggtcaacggctattatcagctggcagacggcacggtgattgaacaggtaattgccagaggaatcgatgtttccagatggcagggaaatgtgaattgggcagctgtagcggcagatgatgtcagctttgtcatgctgggaaccagatccaagggtgttgtagatcccaatttccacaccaacgtacagggtgcatccgcggcaggtcttaaagttggcgcctacatctattctctggctactactccggagatggccagagcggaagcagattttgtcctcagcctggtaaaggattatcccatttcctttcctatcgcttttgatgcagaggacagcgccacccttggcaccctgcctccggcacaggtgagcgaagtgatcaacgcattctgccagcgtatcgcagatgccgggtattaccccatcgtttatgccaatgattactggttatcaaataagatagacttatccaatatgcattatgacatatgggttgccaggtatgaggccaagcatgtttatgccaaccctatcatgtggcaggtcaccagcaccggttccattgacggcattaccggaaacgttgacattgacttcctctataaggacttaactccaaagcttccaggaaatatgtggagaaccattggaggaaaaacatattactaccagaattattctattcagaaaaacgcatggatcaacgatggttccggctggttctacttaaacgaagaagggctgaccgccagcggatggtttgataaggacggattacgttattatctggatgaaaccacgggacgtatgagcaccggatggaagctgctttctgacaaatggtatttctttaatcaaagcggttccatgaataccggatggctttctgacaacggagcgcgttattatctggattccactggtgcaatggcaacaggctggcaggaattaaacggtcagtactattacctggatccttcttccggacaaatggctgtgggctggaaggacttaaacggcaaacggtatttcttacaggaaagcggcgtaatggctaccggctggctggataacaatggttcccggtattatttaaataacgatggctctatggcaacaggctggcataccgatggctccaccaagtattatcttgcagaaaacggtgcagtatctacgggatggcaattgattgataacagctggtatttctttaaccagggcggtaccatgaccacaggctgggtcaatcctgacggaaactggtattatattgggaatgacggaaagatgcagtccggctggcttgaggatcggggagccaagtactatttaagcgcttcttccggtaagatgaccataggctggagacagattgatggatcctggtattactttggcgcaagcggtgccatgacagccggcatgactgaagtcaacggccagcagtattacttaaatccggctgatggaaagatggcggcctctagtacatttgtactggatggtgtttcctataccgctgatgccaacggcgtatgcacggtaacgcctcaggcagcctctgagcagccggcaggagaaggcacggcggaaagtcagcctgctcaaacagaaaccgcacctgcggaatccgctgccgaccagacgaaggaaatcggacctggaatacataattaaatggcagatgaaacgctgtagatcgtggatctgcactgtaatgtgatagtctattccatacacaaagatagctctgaaagcagaaaaatgcgctttgaaaaacggcttttcagcctgattcaaagcgcatttctgattcaagattatttctttaaagtcactcatatatacttttcttgtaagttctcttataccaggtcccttatggaaaggctatatacaaactcttattaaaaactgcttacaaaaagtcccctgcaaagtcttctatactgagttccttatacaacattctcttaatataaagttcttttatacaaaaccctcatatataaaattccgttcaaagaatttttatccaaagcttcatatacaaaatttcatatataaacccttatcaacccctctgatacaatctctctttccctccgcaactatcactgctcagaaaagttcttcgtctccccaacaatataaataggcctgtcctttaactctgcaaacaggatcgcaatataattcccgatgatcccaacaatcagaaacagcaccgcgaacataaagcagatcagcacaatggtagtggcatacccgttaggagtcccaactcttgcccagctccatatggtatagatcatcataacgattcccagaaggcctgctccgcaaccggcataaatcccaagctttaaaggcagattggaaaagcacataatcgtatttaaagaaaataccataagctttttaatactatatttgctctctcccgccaccctgactccggcctcatattcaatggtagtcttattaaaaccgatgttctgcacatatccccgcagaaagcggactttttccctgtaattatccttaagcacttgagaagcccgtttggatatggcaaagaagtcagaagcatttggttcaaacttcacatcggaaagcgcattgatcaaatgataaaaggaggaggaggcaaagttcttgaaccagcctgcggattcattttttgtccggaccatgttgatgacatcatagccgctttcaaatttgctgacgatctccggcaaatactcaggaggatgctgtaaatctgcatccatgcagacgattccatctccgctgctgtaatcaagcccggcaatcatggccgcctcgtggccaaagtttctggaaaagctgattaccttcacctttttatccagtccggataaacggtcaaggatcttcatggtgccatcctggcttccgtcattgacaaaaatcagttcatagtcccagtcaagtttatttaaaattctggccgtttcctcatagaactggttgagagccagttcctcattgtagcacgataccacgaccgataatgtttttctcatgtttgcctcctaatgaatcaaggggatatgccgacatatccagttgattcccaagctcaggactgaaagaaggttttctttcaccctagagctcttcctgttatgttacagtttatccatgctgttgttcttcatttgtttccttttttatataacattgttcaaattctgtcaatgcctgggctgatttttcgctgtaatctccgttcacatccaccattgccaaaaggtttccattatcatagcataccggtatcagctttccaccttcaattaagtccctgaccagtgtataggaacggttttcttctccagtatagcccgcctggacataaacatagtctgtttttgcataatccatgaattccacgaaataatccattttcttgactaaaaccacatttccccataccctgtaatatcatcataggactgaacattgcaagggaataccagcacatccggatggtctccaacagcaatgagcctggtttccggatcagcggcaagaatatcccatattgcaccgtttccctttgaagccatgtcctgcctggcggcttcccgatggtcgtaatagcctttatgggatagtgacacaggtgtaaaaccaaggctccagttccagctggtcatggaggtaacgaatacggaaaataatagcacccagactccgactcccatgcctccccgccacaaggtcttttccctggcttctgacgcagctttcaggacagcaaccgcagtaagtacgtaaagcagcatgaaatagttcccatctacctgagtcagcatggcaaagctgataagattaacaatcaaaaacggcacatagatcactttcaaaaaggcggacagctggcaattcttccctctatccacatttttaccgtaaaaacggcttgcaatccacaataagagaagaaaatacagcagaaatccaccccaggccaggaccacgtggtccatatcctctcctacaggacaaaagaaaaatccattcaaccggtttgccagccggactgctttttctccaagggacattcctgcaccgtaattggggatagaattgatcataaacggatatttcatatgaaaccctatctttgtgagaagggaggagaaaacggatgtaaggggaagccctgtcagcagaaacgttctcgcccagattcctcctaatgccaggattgcacccgccataactgccgctgctccgctgttcttcgcttctgccccaaagctgggaagtaaaagctttcccatcaggtacaaaaatcccattccaaaaacagcggtggaaaagatcagggccgttggttttaaggtaaggctgagaaaaaaggccgccatcccataacccagataacgccaggacttttgccctgcttttatatatctgagaagataatacaccatgatttcctggacgagcagggtgatgatgtcacttttggccgtaaccgccatattcataatacctggaactcccgacaaaagggcagctaaaaagaccgcctgttcccgttttaaataaaagcggccgattttatagcccagaaaaaggactcccaaagacagccacaaattgatcgaagtcacaaaactgtaggatggaagctgggacaaaggcagggtcaaaacctcaaaacctttggaataggtgtagacgatccctatggttcccagattttcataaatcccatggccattatccaggatatagcgggatctgactccgtaccacaagctgtcataatccacggcaatgttaagtctccctgcctgaaggcacaccatggtcagaagaaaagccagaaggaaaatttcttttccgctaaaagccggagcatttccctttcttccgcctcccagacaggatcttcctaaaagcaaaaggaccccggcactgataaaaacaaacacggtcagatgacggatggagccaatgccgatggcagacataatgcaaaagacaactatgagagaggatgcacctgtgagaaaatcagaagccaatccatcttcccttggaagcttacacaggaacacacggagaaaacggccaaagaacaaaatataggccagataaaggcctgtgaccagtaccggaacaaaggccatatgggcccacaaaaagacggccgtgataaataccgccgctataagcttttgactgtttttgggaaacaaaaagcctgataaacagaaggcagcaaacagcgccgccgtctctgccaccatggtcttgtattccctctggttcatgatccactgaaaaacttcctggtctaagatctggttcaaagaatacaggatccctgccgctgaaagaagcataaacaccaggaccccatatccatgcttttttgatctccccataaaaacccccgactgtcattttttatatccatgaatcaaacggatttacgtactgtttctgcatatccagttgatccgcaagggtggattaaaggctgctttactttccatcatcctgtttaaaatcattccggaatatgctgtatccgttttcctttaaaatcgtaagcgcgctccggaccttggccccgctgtctgccctgctgggcctgtattcaaaaccttccctcagttcatcgtctgtagcagtttcaaagtttaaagctaactgcgcctttgtttcaaagcttccccttcggtgaggtgccttttttatctctacataggtggtgtagcagtttcctgccagaaacagtacacaggcagcacaggcaacgattcgaagggaggtctggcctttcctcttcctttgctttgataatagggcaaaggtcagcaggattccaaggatcccggactggaactggagagcatatctggagcttaacccgtaattttcctggaggaatatccacctggacaagacaatgagcacgtggtttaaacctcctgacacgatgaggataagaggaaggaccgtcttttcatacaaacggtaccgaaggttcagccacagagcaaacagatacagcaggatcaccagaaaaccaagaatcaaaaacggagtattggttcgaaagattttctcagcctgttccccttctattaccatggaggaaaaagattttatgaaaaaacggacaaaaaaaccgggcgtatcccttaactggacaagcagaggcaccgtagccggagccgcatgatcttccaccgcataggcattgctccataaatacaggagaaggggaatcagagcgcaaagaccatatccccccaaccccttcctgaatcctcttttttcaacaggtacatgaggccgcaggctaaaatgactgtcaccgaatagatggcacagtaagggcctgccaccagcagggtcgtgaaaaacggaaggagaatcagccttaccctgtcatattttttctcctggccgctccatacacggtccataacctcataatgataataaaagcaggcaaaggataagaaatgagtccagccgcttccattggtcagcatttcccacttgttgagactgaaaagcactgccatcaaaaccccgaaccaggccaaagaaaccttcctgcggctgcagtagcttcccagggccaggccggaaagccccagggccaaaacgcccagtacccggtcaaacatgatgttatagccgaacatagagatgttaaggatccttcccagataattgacagggatcctggtcaggatatccggcacaaagaatttggccggattccatacgtcaggcagataactgtttacaaggcggacgtaatcggaataaattccgtcacaggttgccgtaaaaatataccagaggccaaaaacggttcccaaaagggggaacagaccatacaaatgctttcccttcatgtatttcacctctgcatttaatttgccgttacagaagcaacgatggaaagatgcttctctcctctttgctccgctgcattttcatagaaaaagttgctttcaaaatctaactccgtgacctgaaaggaggttgcgtcaatttcggccgtcaccgtgttggattgaataggaatggcatgtttttctgtcccgttcactgtcaccagaacctgctcaaggccggtgataacgccgggataatagaatttaagaccaatctttccttctttccccgccatgatccgtattttggcactttcatccagccagccatcctcataacagccataaaccggctcaaattttatgttccgcacaaagtcggtaacatcctgaaacgcgttatgggccggatcttctctcaggatcagcatgtttggagtcaccagtccgatatcgtgaatggaactaatgaaagaaacctcggtcccttctgccagcctgtccttgtcaaaggttttaaaaaatgtcctggcggtaaaatcgctcatctcataggaattgccgatgatatagattttttttccgaatatgttttccttgtatttcccgtaagtttcatccgcaagagaattataccgaagctgagagggccagtagtaaaggttctcgtatttcccacggtaaaagctttcaaccggaaccatgagaacaccgtaaaaaaggaacagaccgcagtataaaaggggcttggagagctttgttttggcttcccctttcggcaccaccacaccgcacatgtaagcggcaaacagccacgctgcggtcatggaaacgtagatccaccgggtctccacccggatggtgacgctggaggagccgatgcacagtgcaataaacagaagaaacaggcagatcacaggaaggcgtttttttagctgctcccgttcccgtatgacggttacaaggaaaaccacggtcatcacaacaagaaggatatccgcaaatatcaccaggacatgaagccagtaaggcgatttcccccagcttaagccgtttaaatggtcaggacccgcattgatcccgaataggtagaacacctggctaacggcataccggaaggtatcagaaatgtggaaggtatccgccacatccgttccccggtccctgccggagaaatgctcccaatggtcaggaaacggatagcctgaacggccaggaacgccccggtaatgctcagccagggctttttctgtttttcctttttcatgagaaacgctgcataaaacaggggtaaaagcaccatgtagcgttcatggatgaagcagatggaaaaatacattacggttgcagcaggcacaaaccattttctttccttttcctcggatatataacggtagagacaatagaaaattcccagggcagtccataaagccatgctttccatcaggccgtatacctgactgatctggtaataagacatccgggaaagcaggtataagatcccgcagaaaaatcccatcagccacctgcctgacaaacgtctcccaaaccggtagaccgtgtaggcgatacagccgtttaaaaggatattaaagggtacaaaccagctgatatggcttcccgagaccatcagttccagccaggctgccagatagtaaacgaaacggaaccgggtgcttcccagggggaatacgaattcacggaaggactgctctccgtagcaggaccaaaggtataaatcatccatataaagcccttttatctcaattcccctgtttatgaaaaatgcaaagcccagcaaaagtgcagctgcaatgatttcatccttccacccggctatccattgtctgtctttcatctttcgcccctttcttatttcaatccccacacctctgcacgggagatgtgatcatagttacagaacagcttaaaagaaccgctcctctaacatcaggcagagggcatgataaatgggaagatggagctcctgtattttaaatgtctccatttccggagcaacgatggtcacatccgctgacctttttaaaagtcctccgtcttttcccgcaagaccgatggtcttcatgccaattgcctttgctgctgtcacggcatacatcacatttttcgcattgccggaggtggatatgcctaaaagcacatctcccttccttccatatccgtaagtctgctgggcgtagatcagttctccgtccacatcgtttagaaatgccgtagaaaggcttggatgaccggtcagggctatggccggaaggcctccctgaagcttttctcccaattcttttccaaactctggatctgcctctaacagcttccctgcaaaatcctctgaaacgggacggcgttttacaaagcccttcatcaattctcctacgatatgctctgcatctgcacagcttccgccatttccggcaatcagaagctttccgccgttttcataacatgtttccagaatctcataagcttccctgatctgaggctttatgccggccagtacaggataacgttcaatgagttcgtctaaatagttcattggttccatgtttcacacactccttctctgttgagtatccagtccacagcttctttcatggtgggtgcgtaaaaatcaaaagaattctttttttcttcctgagtcaggccgccgtataattcttttccgtacccggtacccaccaaaaccgtgcccactccatacctttttccggcttccgtatccagaagcttgtccccgatcatataggaatgggacttgtccaccggaaagcttgcctctgccatctcaaacattcctgtttccggcttacggcaatggcattcccggccgtattctccgatcccgtaaaccggatgatgggggcagtaataaaaacggtctataaaggctccttcctttgacagaaggctgtttaagtactcatggagggattttacatcttcttctttgtaatagccccttgccactccggcctggttggtgaccaccacaagcttaaagccctgcactctaagccgtcttagagccttcggcactccgggaaggatcaccagatcttcaggccggtgtaaatattccacctcttcattgatggtaccgtcccggtctaaaaatatgattctgtccatggtctttccctcctttttgctgccctttttccatgcctataatggaaaatgatattcgcctccaggtatggcgaccttaatttcctcataattccaccgtttttcatcgttgatccaggcctgggcgccccgcagttcaaagttccagtccgtaagctgtcccccggccgcttccatgcgcgccgccaccttatggcggacattataggggcaatataccagaaggaatccgccgccaccggctcccaaaagctttcctcccagggctccggcctttagtgcctcctcataaagctcgtcaatgtgaggggtggagatcttgctgctcatgcgcttcttgctcttccagccatagtctaaaagctttccaaagctgtaaagatttcctttcagcagttcatccttcatggcataggcaagggcctttacctcgcacatggcatcaaaaggatcttttttttcatagttctttacctgatcttttatgatgttggcagagatatggatgtttcctgtatagcaaaggagcagattgtactgcagttcatgtatgacctctttttttatgcggagaggattgactaccacgttattgcggccgtggaactcaatgaaattaaagcctccaaaagttgcggcgtactggtcctggtatcctccgtcgatctttaaatcttccctctccactttgtaggctaagtctgccatggcataactgtccatctccacgcctttccatttggccatggccgtcaaaagagctaccataacggtggaggaagttccaaggcctgatcccggaggggcatcgcactgtaagtacacctcacagccctgtttgatatccattgcctttaaggctgctgttaccagatccagacgcccgtcatatacataattttctttggtattgtacttcaccgtcatgtcaaagtccagggaatggacgatgatctggtcatcatcccttggcacgatggagcagtatgcgtatttattaatggtgctgccgataattgcccctccctgctccacgcagaagggagccacatcggttcctcctcctccaaagctcacccgcaggggagcacgtcctctgattaccataagctcacctctcttttcccctctccgcccgtgttctccgggcataaacctgtaaggtgcttcctcacatcttctgcaaaccggtaataatcctcaggaatgccgatatcaatgaaatatccgtcgcttacaaagccgcccagctttttgccctctgaaagccatttgggaatcatgtcctgctccagggacacctttccctggggtatctcatcaagaagttcccgcttaagataataaatgcctccgtttatggtaccccggcgcttttcgtcagtcttctcattaaaggtcttaagccagccgtcttccagaacagcctgtccgtagcgggacacatcaggcacttcccgcagcaccagagccatgtcaaggccgcgctccttgccaagggatgtaagtctgctgtaatcgattcggtaaaaggtatctgcattcaatacgagaaactggtcttctgttaccttagcaccggcatttttaatggcaccggcagttcctaaaagctcttcttcataggcatatgaaacatggattccccatttggacccatccttaaaatattcttctaccatggaacctttgtagcctacggcaaaaatgattgacttgactccatttctgatcagttccgccactacatattccataaaaggcttgtctccgatcagcgccattggctttggcctgtcactcaccacggaacgaagtctggtgccaaggcctcctgccagtaaaattgcctgcatatctgtatcctcctgatatttctgctaacggtattatatcataagtttgcagtgcagctcgtaaaacctgcggttttacttgctcacgggcattcgccctatgaaataagtcatgaaaaagttttcttatgtgcaagcacaacgaaagcttttccctgccttatttcgcactgctcagtgctttcctggatagtataacatatatctcccacagtgatccataaagatcatttctgtggcttccctgcccaggtctgaaacacgcgtcccaggccatgaatggctttcctggatcctatggcgaaaagcaccggaagaattactcccaaaatgaggtagaccgcatgaagctccggataggaatgggggaagcctccctgattttctgcaggctccagtatgatctgggcataaatccggtcacagagcttaaacaccaggaaatgaagagccatgatatcaaaggaatattttccaagcagggccgcagtcttcccggccataggaatcttttgcaggcattttgccccatagcagcaaagataaatgccggctgcggaaatgatatagaaattgatcccttctggtatctgattggcggacagctccacactttcttcggtaaacatgaggaaataatagaaaagtcctgcgcaagcggccgctccataccatgtcacatatttttcaacggaaatcttccaggtccgcagggcatatccgccatagtagatgggaattaccaggaaggcggtctgaaggtggtagtttaagaatatctcccgccggctcagtgctgcgccaaagagccctgccccgatgcatagaaccgcagccgcccatgcccgtagggaagcaggcagataattccggcaaaaccagtggatggctgaaaagcctgttccggacgccagcatgagaggcacaaaccacatggctcctgacgggccttccggacagcgaaggaacagggtatttcccattgcaatgagcatttcccttttgccgtaataggcatcagacggaaaaagcaggtaccaggaaaggaggttatgtaataaaacgaacatgcttccatagcagaaataaggcacccacatgttctttagccgccgtgaaaaaaattcaaagggggcatccccataacgctcttcattgtacagatatcctgaaacgaaaaagaatatggccagatggtaataatacaccgtacggatggcgatccccaggttctgggaatggccgaacacaatggatacgatcccgatcccttttaaaatgtcccagagcagaagccggtctctctttttctcttccatgcgatcctcttcctttcctgtcgccttctcctttgcccttttatcccgattcaaataaatcaaagcgcacctactgcgaggcgcgggtcacgctctgggtgacaccatacatttacgcgcctctgcaatccaatggagacgttaagcctttccatctaaaaatcttctcccaccacgttccaggcagcctctatgctgtgatactttcggatgtaattctgagtttccagacacatctgcctgcaccgttttgtgtcctgatacagggaaaccacttcctctgcaaaggccttcggttcatctctcaccaccataacctggtccgcttccgggattccctctgctccaatggaggttgtgaccacgggagcgccgttatataaagcttcaatgacctttcccttgacccctgcgccgtaacgcagaggcaccactaccacccggcagcttaaataaagcctttccagttcgtcctctgatacaaatcccttgacaatgatcccgttgcccggctgttccaaagccttgatctcatccgttactctggaacctacgatatagaaattcatggaaagctgttcccggatcagcgggaatatttcctgtgcaaaccataaaactgcatctgcgttaggcggatgagcaaatccacccacaaacaaaagtccttcccttttttcaaaatcatcgggaatgtggtttaaaaacttttcatagacataggccacaatggctttcacatggatggatggctcgatctcatgaatggcctcccgctccacataagacggataataggataccgcagtctttttcataaggcgaagctccacagacttccagtactcggaagcttccctcttcttgggatctccggtcagctcatactccctgccttctcttaagaaatgcagatcatgtccataataaatcatcttaatgtttgtcttatctttaataaaatccacatattttgcagcgatatggggacggtttaaataagcaacctttatatcatttccatgttccttcagccattcccagatctttacctggtattccttaccgtagagaatctcgatccccaactgctgcaaagcggtggaataaggctcttcatgaaggaaattatctccaaggaacttcaccacataacccttttccaggaacatctttaaatactggaaggtggtcttggaaccggcatccctgtcataggtgggaacataatggtccacgaccagtatgatgtccttaccctggcttctctccctggcccggaaaacgtcgggatttccatcgttttcactttgctgtttcagttcttccgtccatttttcctttagctttaagccgttttccacctgataccgcttaagtccagagccattgacatccgttccgttggaaatgccctcaaaatgaatgaccttggaaaagggctgataaaccacccgcagaccggccctgcgcacctcaaaggcaaggtcagaatcctcacagtatgcaggggcataacggtcgtcaaatcctccgatccgtttccacagctcattggaaagaaggatggcggccccggatatatagtccacatcttttacatagttgtattccggcttttccggatcgtcgagacgtccgtaattccagccggatccgtcgcggaaaatgatgcctccggcttcctgcagtcttccgtcagggtagaccagcttggagccaaccatgccgatggcaggatcagattcaatcaaattcaccagactgcttagccagccttctgttacctgggtgtcattgtttaagaacatgacatattttcccctggcagccttggcggcctgattgcagtttcttaagaatccctggtttgtttcattgcggcatatgaccacattttccgtaaattttgaaagctcagctgttgcatctgaagaaacatcgtccgctatgataacctcatacaccacatcctttgtatgttccagaatggacaccagacaggcataggtataatggatctggttgtatacgggaatgatgatggacaccattggatggccctcttttatgaaacgaagctttccatggacccggtaggcctctccgatcttcatatccccttcaatcaggttccgcccctcttctgttgtataaaggcggaaggattttaagggatggaacaccgtatccttggcgtaaatcagcagtttccgtttttgggtcccttgaggaaacttatcgttaaagattcttcccagctttcttctgacacggtaggtcaatgcctgatgtctctggagggtggcgatcatttcactcatattgctgcaatctgcccgcagcgcctggatgatagcttcctggtttcccacatgattgtcagtcaggcgtttctcctcctgctgcctggtgatgagcacatccttttcccggatctccatatccaactgggtaatgtgctcctttgtctcgtcgatcaccctggatacttcatacatgtcttcaggcagggcatgggtttcatgcatgtagttgaccaggtagatctgctggttctctccgtgaacatagtcctggaagcaccgttccatctcctcataggtgcccaggcgctctgcctccacgccgaactcctccataaaggcttccatggagccataagacaaaatgcttttatactgttcataaaagtaataaaggacccggaactttataaaggtgaccgggaccgggaaggaaaatacccattcatagtccaggcagtaagggccatcctccgtgatcatgatgttctcaaacagacagtcaatgttggaggttttaaacgcccagtcctttttaaagcgttcatcagcttcagtcagcttcccaaagacctcttcaaattcaggcgtaattgtaaagggaatgatgcagttttcctttgcccccatgatgagggaaatcccatcttccatttgtggcacggaaacctttccatcctggatctcttttcccagaagctcggaaagggtctggcctttcaggaaatcgaaacgggcagtccttccatcggaacttatggaaaccccggcaacctttaacctttggttttgctctgtaaggcttttatattttaccccaagggactttatatgggcaacgccctcaggctttaaagccgtcttttccacataaggacagccatcctgctccaccaggctggtacgtatctggaacgcttccctgcgggtcctgttgtattttacaaaattaattttcttcatggctgctccaaatggttaaaaatgaattggcaaatgtctcaaactgctttccctcacacacctcgtcatacatctttcctaaatcaaaccttaaatacttgggataatcgtaagccaggatggcatgggttaaatctcctttgcccggcagatatccatcggaatataaggtgataggcaggcggtaatcaggcattggatagtaaacttccacctttccctgtctggtctcttctccacgcaaaagctctaaaagttcttccctggaaagccggtcctgatcagggacagcacctgcctgatatttaaggccaagacggttgcatatggaaaggatcagctttccttccggctttaaaagggatttggccttacttatgtgtttgtcatagggctgtcttaaggaaccgaccattaccacataatcaaagccttcctcttcaaaggagtctaaatccccggttatataccggatgttttcctgtgcctcattgcgcaaacggttgaccgataaattgtgactgtcagggtcaaggacggtcacctgcctgacccgcctgctgtataagccggtcagggccccgtagtcagaccccacctgaaggagagaacccgcctcatcaaattcataccattccaacaggttctcacgaatctcggataacgcgtacaagtagtccagattggggttttcctggagcagctttttcgtatctccatggtatttaataaacagttttttcagttcagggctgatatcattcatggacgtttcctcctcactctcctgcccggtaaagctttaagcttacttccggttccatatcataaatacctaccgtatttttattggaaatgaccgtaatatttgcgatgtcatacagacggtgataaaccacatgttctccgttttcaaatccggtgcagctcatggaaaggagatactctcctccctgaagggtcattttctggttaaattccacctcatattcatcgccattttccacggcctgcacatcggaggcctcgtacatggtgttggtgccggtcaaatcggctccccgtttatccttgatggtataggtaaagatgggcgtctcgattttcgtatgaaaatgaatccgctcctttatggtaaagcgttcccctttcagcagaaggttagtcacattccctctttcgtccagaagtccgaaatccacgatctccgcccgtttatcgccgtattccgtgcggctggggttgatggtgagcttttccttcataaacccttcctggcgggaactttgggactgcatctgaactgaggcctgttctccggaaaagtcatttaatatgccttttcttatttcttctaaatcttccccaaggtcatccatttgattggccaggatctttttataaagatccaccatctttccaggctctccctcggcgataaaatttcctttatttaaaacaacgacgcggtcacaatatttgatgatcgctcccatatcatgggtaaccatcaaaatagtggttccgttctgacggatttcttccatacggcggtagcatttggcctgaaaaaatacgtctcccacggacaatgcttcgtccacaatgagaatctcaggctccacgttgatagccagggcaaatgccaggcggacaaacataccgcttgaataagtcttcacgggctgatagacaaaatctccgatgtccgcaaaatccaggatgtcccgaagctttccatccatttctttcttggaaaatcccatcatggtgccgttcatgtagatgttttcgattcccgtataatccatgttaaaaccggctcccagctccaaaagtgcggaaatcaccccgttgacctccagggtgcctgaggatggtgttaagactcctgtaatgatttttaaaatggtggatttccctgatccgttggttccgatgattcctacggtctgtcccttttctacctcaaaagaaatgccgtttaaggcgtagaaatcacggtggtaatttttatgggtcacgcttaaagcctcttttaaccggtcaacaggcttgtcgtataatttatagatctttgttacattattaacagatattgctttgttgttccattctacggacattgaatcctccatgttacattaaattatcccttctcacagcacatcggaaaagtgcgggcgcagctttttaaatactttcagtcccaaaagcatcaggacaatggtcactgaccagaaataaagtcccagggtcggccgttctgtcagccagtttccggtcagcatgctgtcccggtacccggccacaatataatagaaaggattcagcttaagcagaaccggcagccaggagggaatcgaggaaaacatttccggcgcccacatgatgggcaccatccacatcccaaactgcaggaaaatgcctatgatctgtgccatatccttgaaaaacacgtgaatggcgctggtaaaatacgcaatagccagagacagcatggagcttgcaaaggaatagtacaggatctggatccagctggcctttggaaaaaagccatagcagaaaaataccacgatcatgatgattgcaaaaatgccatgtaccatcaggcaggaaatcatcttgatgaccggaaggatctccacccggaacaccacctttttcaccagataattatattcctgaagacagccagttcccatgttcagcacctcgctgaaataaaaccagggcacaatgcccggaatcagccaaagcacgtaggggtattccggaacagggggcacgctcttaaagcccatctgaaatacaaaaaagtatactaaaaccgttgccatgggctgtaaaaacatccatgcgatcccgaaataggagcctacaaaccgttttttaaaatctgcctttgacagatccaggatgagcttcctctttgcaataatttcttttattaaggaaaccagatatttcatggttttctcctctcgctaaaatttaaaggtatcccggattccgccccacttctgatccttttcagagatgatcagctccatgccttcctctaccggccagtcaatgccgatctccggatcgctccataaaattccgccctcatcaccgggatgataaaaatcagtgcatttgtatgcgaattccgcttcatcagacaaaactaaaaatccatgggcaaagccttccggaatgtaaaactgctttttgttctccgcagacaactccacgccaaaccattttccataggtttcggaagcggaacgcagatccactgccacgtcaaatacccttcctctcactacccgcaccagctttccctgtggaaactgcttctggaaatgaaggccccgcagtacgccctttacggacatggactggttgtcctgtacgaaaaccatgtcaagccctgcctcctgaaagtctttctggttataggtttccatgaaatatcctctggaatcgtgaaataccgcaggctcaatgacaaaaagtcctttgattccgcatgttgttacttttatctttcccataatttatgctcctttacctatcaaaacattcttttacttgtagcattctaccacaagttgggccagatttctatatatagggggatttttatttaaataaaccgttcctttgcggacaaattatgagaaaagaaaatgcggaaaatgtcttttattgcagataaaaaatgctgtctctcatacgaatgtataagaaaacagcattttagaatgtcacttccacggaaaaataatccttaccaacttactgcttcacaataaacgactttctcttactcaccacatcaaatataactgccgccataagaaccgctccttttaccaccttctgcaggttctggtcaacacccatgatgctcatccctaagttcagcacgcccataagagtcgcgcctacaataactccaggcacagttcctgtaccgccgtatgcggaagcgcctccgataaagcaggcaccgatggcatccatttcgtagctgtttcctgccgtaggattggcagaatttaaccgggcaacggtcaccatacctgccactgctgccaggagacccatattcaaataagcgagaaaatacactttattggtgtcaatgccggacagcctggttgccttctcatttccgcccacagcgtaaaaataccgtcctgtggttgttttggaagaaatataactgtagatcccaatgatcgccgtcacccagataagggcgtttggaatccctttatatctggccagcttatacataaagaacaaaaccacaaagctgataagagccattttgacagccaggcctccaaggggatccacccggtatcctttttgaagctttcttctcctgtttaaaagctccagaaccacaaaaacaagacaggcaatgatgcccaccagaaaacaggtcaggttaaagccctgaataccaaagatatccgggacataggtgttaaacaggtttaaaaatggttccggaataggggacaaggtcattccctgtaaaaccacattggataacccccggaacatgagcataccggccaaggttacgataaaaggagggatccgcacgtatgcgatccagaagccctgccatgcgcccaccagtacgcccataatcagcattgcaagcaaggtcagataagggttaatccccatggtgatcatcatgcttccgcctatggcccctacaaaacaaaccacagagcctacggacaagtcaatgttgcctcctgtgaggatgcaaaaaagcataccagtggccaggataaatacataggcattctgggcaattaaattgttcacattctggggcagaagcatctttcctccggtgttgaccgtgaaaagaatgactacaacagccagaacgatcaccatcgtatatttttttaatccctcagataatttcatcttattctccatcttctacacacctttcttctagctttgcccgtattgcctctaatttgcccccgcttcagggcataaagggatgccctcagggtgtttatctgactttaagatacaggccatgatcttttcctgagtcgcctcggccgcgctgacctctcccaccattcggccttcattcatgatataaatccggtcggacattccaagcacttccggaagctctgatgatatcatgatgattgatttgccttccgaggccagacggttgatgatgcagtatatctcgtattttgcgcctacgtcgatccctctggtaggttcatctaaaatcaggatatcaggttccgcgaacatccattttgacagaaggactttctgctggtttccgccgcttaaatttcccacgttctgttccactgtggggcatttggttttcagcttatcccggtaatcctctgccacctcaaattctttatccttatcaataatggtatggcggctgacggcctgcatattggcaagggtcgtgttgatcttaatgggagtccccagaatcaggccgttgcccttccggtcctcagtgacataagcgagcttgtgacggatcgcatcccggacagaatttaatgatgtctcttttccgtgaatgcggattgttccggaaatattgaccccatagctttttccgaaaatgctcatggcaagttctgttcttccggcacccatcagaccgcagattcctaccacctctccttttctcacatgaaaggagacatcgcttaccaccttccggtcagaatacaaaggatgacaggcactccagtgctctacctccatggccttttcaccgatttccacgtcacaccgcctgggaaaacggtccaccagctcccgtcccaccatgcctttgatgatccggtcttcggtaatggcatcctttttcctgtccagagtttctatggtcgagccgtcgcggatgactgtgatcttatccgccacataggcaatttcattcagtttatgagaaataatgatagaagttaatccctctgatttaaatttcagcaaaagctccagaagggacttggaatcatcttcattcaatgatgcggtaggctcatccaggatcaaaagcctggcattctttgcaagagcctttgcgatttccaccagctgctgcttgcctacgctgatatccttgatcagtgtctgggaagattccataagcccaacggtttttaaataccggtccgcctccccgtaagtttcattccagttgattgcgtaccttttccccttttcatttcccagatacatgttttcagcaatcgtcatgtaggggacaagggccagctcctgatgaatgatgacgattcccttttgttcactgtcactgatatggttaaatttgcagatttctccgccgtaaataatatctccctcataggtgccatagggataaatgccgctgagcacgttcatcagagtagatttaccggctccattttccccaaccagggcatggatttccccttcctctacctgaaggtttacattatccagagccttgacgcctggaaatgtcttggttatgttcttcatttccaaaagtatttttgccaagaatatccctcccttgccgtcatttcttaaggacggcctccacacctgtaagaagccgtcctcataagaaaatcatttaattactttaactggtcctccgtgtagtaaccggaagtaatcaacatatccttgtagttgtcaaccgttaccactaccggatcgcataaataggtgggaatgatcccggttccgttatcataggatttcgtatcgttgatctccgcttctccgccctgcataacagaatccaccatctttactacctgggacgcaagggtacgggtatccttaaaaatgctcatggcctgttttccctggagcatgttctttacattggcaatatcacaatcctgtcctgtgatgatgggatattttccggtataggaagaagcaagggcgttctccactcccagggcagtggaatcgttggagcagaggactgcgtccaatacggttccgtcagaatagttgcctgcaataatggtatccatacggttctgggctttctcagaatcccagttagcagtggctacctgctcaaaagcagtctgaccggattttaccaccagcttgccgctgtcaatatactttttaaggacatccattgccccgccaaagaagaaattgcagttgttgtcagccgggtctccggtaaacagctcaatgttcttaggctccgcagcggtctcaaggcccagagcctctaccagatattcaccctgcttttgtccgactttatagttgtcaaaggttgcataataagtaacagcatcagagttcatgatcagacggtcataggaaatgaccggaatgcccatggccttggcctggcttaagggttctcccaatgagcttccgtcaatggaagccaccacaaggatctggcagccgttggaaatcatattctctacctgggatacctgagtctggacatcattgctggcatactgtaaatccaccttatatccggcggcttccagttcctttttcatattggatccatcctggttccaccgctgtaagtccttggtgggcattgcaactccgactaaggttccgctcccccccgttgctttggtttcctctgccttggtctcagccgctttttcggcttctgtggtggctgctgcagtcgtctgggtctctttgctctcaggtgcagagcctgtggagctggcacatccggaaagcattcctgccgtcagggcaaaagccattgcagccgctaaaaattttcgtttcatggtatctcttcctcctccaatatttgttttactgacaaagtcatcttatcacggatagaacaggacttgtttgtgaacaattagcacgtattgattcaaataaaaaaggccctgaatgcacaggactttttcgcagcaaaaaaatgctactgctgtgattgttgatgagaatgaggctgccaaaacatttgatttcagcagagacgattccaagacttccggttgcaatttttcaggcatcttgttagaataatcttggtaatcgtttcatttataattgatctcagcctggcaagttatctctcattgaaaaaatatggtggttaaatggaaatcagaaaattggcttattttgtttcagttgtaaaacataagaattttacaaaggctgcccaggaacaccacatggtgcaaacagccatgagccgccagattgcggccatagaagaagaagttggagtcgtcttgcttaagcgcaacaacagaactgttttgcttacacctgcaggagaagttttttatcgcaaagctttaaaggtgatagaactgtacagtgatatgatttctcaaacacaaaagacggctaaactgcatcccaaagtattagaaattggctttggccattatgaacatattttaatagcacaggtagtttctgagtttaaggccctttatccggatattgatgttttggttgcaaagtacaactataacgatcttataacatacctgcaagccggaaaattagatatcgtctttactcttcctttcagtcctgcttttgtttcacaggatgagaccgtggtaaagccggtttttccttctactatgtatatcattgtaaataaaaagcatcctcttgctcagtttgatatcatatcagccgattcactgaatgaatatacattaattaccttaagcgaggattcaggcccctgctctctggagaccttaaaacaatttacaatgacggccggctttaacatcaaagacagcatgaatgccaacagcctggaatcgcagatattaatggtggaatcaggactgggtgtggcattcttgccaagtatttgtatcaagcatttgacaccgaatgtaaaggccattaatttaaaggattttgaccccggtaattttgttgccatgtaccagaaatccaatgaaaatccttttataaaaatctttcttcaattagcttctttaaaagacaattaatgaatggataaagagaaagggatattgcctgactaacttaggttagttctgcaatatcccttttgattttactgccttatttattcttccgtttttttagtgagggctatgcctacgcatagaaacagtccaccccatacaacagaacaaccgacaagcatcatagccaatgcaaatggattcatagtaatttcccccttgttgatggaatcagatcttaaagtcattcaatatcagtttgccatggacgtttaaagaatacaatggcaacaccgatcataagtacaaccgttccccagccgaacacaatatttgatatcagtgttacagaatccataccaaacatcttcatgataccggatacaaaatttgtaataacagtaattcccaataagatgggggtaaagtattttaataagtaatcccaccatttaccgatcttaaagtcagaatattcgtttgcatcttctctgagtttctctgtaccgtaaatgtaactgactgcaactacttccaccaggccaagagtagcgatcacatagtttgccacgtaagaatccaccagatccagaatatagttaaatccgcagtatgtggcaaaggtggcacttccgataaaaccggcgatggaaatgatgttggtcaattttttacgcgaaatcttaaatttatccagggctgaagtattgaatgcctcaagcatagaaatgctggaggagattcctgcaataaataaacaaaagaaaaacaaaaatcctaaaataccctgaaccacaatattagatgacatggttgaaattgctataggaaatgcaataaaagcaactccggccccggttccgaaggagtcgaaagaaacgccttgtttattgaccaaaaaacccagggttgaaaatacggtgattcctgcaataatatcaaaagagctgtttgacagtacggtgataaaagagttgtttacgatatcctgtttttctcccagataagaaccgtaagcaatcataacaccaactgcaagtgtggtggagaaaaatacctgtgcatatgctgcaacccatatgctgggatttaaaattttagaaaagtccggtgtaaacaatgcattcaatccaatatatgacccctccagcctcatggagttaatcataaaaatgatcatcaaaatcataagaagaggcgtgaatatctttgaggccttttcaattcctccggaaatcccttccggacaatggcccagttgcaaaaccatactaccaccactgcgcccagcatataaaggctgattccgcttccaaagtcgaaagcattctgggcctgcccggtaataacacctaacagcgggcccgggttgctcatccagtttacgataccaaaggcatgaccgatacagtagatcataaagaccacggatatggatatgatggtgctgtagaacatcatgaccacgatgggcaccataacctgtacccagccaataatctctaatttcttctttagtctggcaaatgcctttgttgaaccgcctcgtattctccggccataggtgtattccatgatcattaatggaacggcacatgtaataattgctacaaagtatggaagaaaaaatgctccaccaccatttttataagcttgaaacggaaacctccataaattacctaatccaactgcagccccaattgctgcaaataaaaaacctgttctgctgttccattgatctcgcatagtaaataccccctaatgtcggatatattcttaatattcgatgggttccaaagatgcctggaagtggcgtaaaatcggcggctcccaggtgatgcggtatccgcgtttgatttcagatgctctttccttgattgcgatcaatgcatcagccatgatgtcaatatgggcctgtgtataaacacggcggggaatcgcaaagcgtgtgaattcaaactcggaatgaagctgttcaccggtatccgggtcgttacccagcataaaggaaccgatgtcacaggtacggattccagcctctttgtaaagctctattgcaagcacctgcgcagggaattcattatatggaatatgagggaaaaatgctgctgcatccacaaagaccccatgaccgcccaccggtgactggtaagcgattcctgcctcgtctaatttacctgccaggtattccatctgaccaatgcggtatcttaagaagttttcgtcaataccctcataaagaccaattgccagagcttcaagatcccgtccggaaagtcctccataagtaaaaaatccttcgtatgaaatacagttggcttttacttttaaaattattggagaattgccatcctttattccgatcagaccgccgatatttacaattgtatcctttttggcagacattgtaaacatgtcaccatagctgaagattttgttgacaatttcttttatggacatattcttgcattcttcttcccgctgctttatgaaaaaagcattttcagcatatctggcggcatcaatgttaagaggaatatcatactttttacaaatttctgatacctctctcatgtttgccatggatacgggctgaccgcctgccgaattgttggtaatggtcattacaacaagaccaacattttcagcacccagttcattgattagtttttctaatttcacaacatccatgttgcctttaaacggagctcttatagacggattttttgcttcttccaccacgcagtcaatggctcttgcccctgccagctctacatgagctcttgttgtatcaaagaacatattggaaatagcaaatttacctttggaaaggaaaatcggaaaaagcaccttttcgccggcacggccctggtgaaccggttgtataaaatcataaccaaatatatctttaccggcatcaattaatttatagtagctggatgaaccggcatatgcttcatcgcctttcatgactcctgcccattggccgtcactcatagcattggttccgctgtcggttaaaagatcaatatagacatcttctcccctcagactaaacaaattatacttagcctccttgattttttccaaacgttcctcttgatttaacattttaattcgttctaccattttgattctgaacggttctggaatatactttacagccatctttgtttctctccttttgctttttatgtgtatttttaatatgtttttattttaatacattaaaaatcatttgtaaaatgactaaaaaaggtggcatcacaacaaatttattatgatatatatccaaaaagcgcatgacgggttacgatttgataaaaaagagttaatctcacaatataaaaaagccctgattgctcaggactttttcgctgcaaaaacatgctactgctgctttacatttaagtacacatcttcttttccatggaatcctccctgaatgatgacggaatccatattctccctggtgaccgccaccggcctcagttccaggcttggaacatcgtaggttccatcgttaatagtagtcttaattccttccaacggctccccttttcccagcttcaacgcgtattccgcggctattctggcttcttcctccacagatttaaaggctgtcatattctgggtcccttccacgatcctctgacaggccattaaatccccatcctggcccacaagacagactcttcctgccagcctgtcttccgacaaagcccggaaaacctgggtagccagatcgtcgtttccacacatgatcccctttacatccgggtattgttccaaagcttccttggcataatcaaaggcatgctccgctagccagccttcacagttgcttttatagaccacctccaggttttttccctttattaccgattcaaagccttcccggaccattgccacattatgatccgtttcaggcccctggatcatgaaaatcctgcctccctcagggatgttttccaccaggctttctgccatcagcgttcccacctcccggttgtcaaaggatatgtacatatcgcagtccgcattcctgaccagccggtcatagctcatggttttgattcccgcatcctttgcctttttcatcacatcggacaatgcttcacagtctcctgccaccaccacaatcacatccatctgcttttttatgaagtatttgatctgctcaatctgttcgttcacatccccgttggcattttgtacattgacttctgctcccagctccttagccgtggatacaaaaacatcccggtccctgatccaccgctcgatcacaaaggaatcaaagctcagcccaatctgcagggggctctccccggcctttgtcaaagcctgggtctctgtctctgccttagcatttgtgcatcctgccgtcagagcacagcagagcatcaccaccagtaacaatctccctcgacccattttcataacactttacctctccctgtattcgcttggcgtcattccctcatactttttaaatatccggctgaaataattgggatcactgtagccggacatgatgcatacctccttgatgctgtatctggaatcctccagaagacgcctggcatttttaatcctggttctggttacatattctatgaaattctctcccacctcctgtttaaacaatttactgaaataataaggacttatgtcaaccattctggaaacatcgtcaagagatatatccttggcataattctcatcaatatagcccttgaccctggaaactacattttcatattctctttccctggaagtgctgatattatcacacacctccctggtcttatctaaaaaccaccgtttcagagcttctccgtcggcagcctcctttaactcctctaaataattctcccggtagcggaagccatagcggacattgcctgcctcaaaggcccgcctttcaagcctcatgaccagctccaatatcttgatttcaatgttagaccgcacatttccgtcgtgagccagcatccagtcaaagaattcgccggcgcaggacaatgccccttcccggtccgccttgattcctctttgaaggtactggttttccagctctaagggatattccccgtcataatcagacactgcaggaatatccgtgatatgcaccacatggctgtcgctttcccgcagggatcttaatgcctctttataggagtccctgattccttccagaggctttacggagccgattccgcccctgcacttaatgtcagtggcgctttccagcttatggatcatgttccgggttcttgtaatgatttccacccgttcctcataccgcatcttttcctgttcaaaggaaagaaacagtgccagccggtttcccatagcaggtcctatgacgcagtcaaaataatcctttacgatttccctgaccatggaataaagcttgttcacccggacgctgaccccaatggcgttggtcatggttccccttcaatgctgtccccgaattccagaacgatcatgaatccataaggcttttttatgtccagcatttcaatatatccgcttttggaaagctccgagtcctcctgaagcacattgtaaatgaacccgctttcgatcatggggatcacgatctcaagcttttccctgatccttaaatcatcgctaagcttctgtctggcctcctccacctggtgcatggcctttacacacacatccaggatcttctttttattgaccggcttcatgatgaactccatgacacctaagttcaccgcctcctgggcataagaaaatttatcataggctgttataatgatgaatacaacggaaggattgaatttgcgcacctccctgatggcctgaatcccgtttaaccccggcatctggatgtccacaaatgcaatatccggccggaaggaaccagcctgctcaatgactgccctgcctgttttaacgcaggcaatctcacaatcgctgccaaaattagactttatgatatggctgatggactccagcatgattccctcgtcatcagctaccagtatacgaaacatgtacctctcccctctttttggaatccttaggatcacagtggttcctttatcttttccatcactgaatatgtggaaaatatggtcatcattataataaagctccagccgggagatcacgttgtggatgccgatccccgtagaacccgccgcctccgtgatctggactccgccacggatcctgtcaagctcttcctcttccatcccgatcccattgtccctgatgcagatctctatttcctctccatgatcctctacggtcagatggatctcgccctttccttccatattccggattccgtggttcaccgcattttccaccagaggctgcaaaatcatgctaggaatgggaaagtccatggtttcctcatggatcagggaatgataccggatatctcctgcaaaacgcacattgaggatataaacataattctctaccgcctccacctcttcacggatggtggcatcccttgaacctttttttacattatagcggaagaaatccgccattttctccataaacacggaggttttttccgcatcctccatcatggcaagctggactcccgcatttaaggaattaaagaggaaatgaggattgatctgggactggagatattttagctgggcctcctttaaatggttttccatcaaaaactcccgctccttcatctcctgttccttttctgcactctctttaattttattcacatactcgtccaaactgtccaccatttggttaaatgtcccggtcacgattcccagctcatctcctgtgcccaaggatggcacctttacgtggaagtttccctgtcccaccagcttagccgtatgagccaggttggtgagcggggtaacaatatcctttgtcatcatcatcataactgtcaggcttatgaccatgacaatcattaaaattacggagcttatgacctctaaatactgcagggcagcctggagggtctggtagctggcggaattatttttaaactgacggctgtttaagaccgaaatgtcatggttgatgaactgataaagctttagggcggattcataagagcttttgtatttttccacattctgcccccgcttagcctggacggtctcatccgtgacggccagatagctgtccgacatgttgcggatatttttctccagtatctggatctgattatcggtcacggcaacattaagcccttccagcagcttcctgtaatcctgttctgcccggtaataatcggtcagggactctgaatccttgacctgcagatatttgtacatgtaattctgcacatcggtgaaaacgtctgacagctcatttaagttcacgttgcttatgtatacggaattcatacgctccaccatctggttgatctgggcgtaaataaataaattgctggcaaaaagcgtaaccgccgtcactgcaatttccaaaaacagctttcgggcaatgggcaggttctcccataggtgtttccatttatttttcataattactccactgattacttactcatgaaatccggcgcattttcctttgttacaaactgtaagtccacgctgtaaaaggaattggtccttccgtcatgtatggactcggtaagggcctggacgctgtatttccccatctggctggtatcaatgcaaagagtcatggccatggtcccttttctgaccgcctctaaggctgcccttgacttataatagccgatgacctgggtttttcctacgctgttataatctatgaccgcctggtacacagcctccgtatccacctcatccatgcacacaatgatgtccggcggcccctggggattctggaataaattgcgcacaatttcctctgcttcaaatgcccgtccggatgggatcttgctttcttccaccttgatccgtccccgctctcccttgacgtgatcatccggttgttgatctggttaaagatctgggactggttgctgtcaatggaattgtcatgaaggagcaccattaccctggccttctgagagtcaggaggcaaaatctttaatatctgattcccgtattcctgtcccagctcataggaattgatcccaacgtagcttttccggtccgtggaaggcgcatcgtttagtatggttaccacagggatcccttttgctgccgcttcattgatccgttcctccagattttcttctcccgtaaattccagcaggatcccatccacttttgcagctatgctcatatccatgaaatccacggcagtatattgggacgactggttcctccccttaagctccacataagcgtcgtgtaaggctgcttcctgacgtacgctttgatacacgtcattccagaactgggaatctaagttgttgatgatcatgacatagtgataccggtagttcctggtattttccgcatgctccaccccgatcttttttaacacatacccataaaaggaggaggtcaaaagtgtaaggaacacgataccggacaatcctccaagcaccagcagaagcaggcttttctttctgttatccatggttttcccctttttcaaatagcactgaattcattatactaaatcatagagaaaaataaatggaaaacagtctggattttactggaccagaaagaaaggctgctgcagatatttgttatttttttaactttttttaaaataggtcttgcaaatcatttttaattaacctatcctttgttttaaggatatcctttataacttaaaggaggaaataatatgaatcaagaaaaattgaaagagcttgaaaagacgataagcagtgactatgtcaatatcacgggcattcttgtacaaaaaaacggcataaaattatatgaaaactactttcacggatatacctccgataacgccactcatgtgtattcagtgacaaagagcgttttttccgttttgattggtattgccattgataaaggccatatcaaaagtgcggaccagaaggtgcttgactttttcccggattacactgttaaaacagacgaaaaaacaatacaatgcattacactgaaacatttacttaccatgacggcctcatataaatataaatctgagccatacgaggagttcttcgcaagcgacaactggataagggctgccctcgatttattgggaggcgagggaccatcgggagaatttatgtattctcccatcattggtacacatatcttgtcgggcattctcgtaaatgcgacgggccagccggttcttgatttcgcttcggaacatttattttcgccgctgggaattcatgttacgcacaatgtggtgctgcgtaacaaagaagagcatatcgccgttatgaatgacagaaacatcagtggctgggttgttgacccccaagggataaacacggcaagctggggccttttcctgacgcctggggatatggcaaaaataggccaattgtatctagatggcggaatatgggaaaacaaacggatcatatcagaggaatggataaaagtaagcacaatgacgcacatcaggctggaccggatgtcttatggttacctgtggtggatcatagatgattcagggcatatctatgcagccttgggagacggaggaaacgtgatttatatcaatacaaagaaaaaaacagttgtttctattgcttctctttttatgccagaggctaaggacaggatcgggcttattaaaaagtatattgagccaatatttgaggattgagaatggcagatccgcagttaccccatgataaccgaaatgcgaagcataagacgtaattacaccatagcaaaataaccatataatatttaataggctcaaagtatattttgagcctatcttttatctttcttttttccaatattccctgttcatggtaacgcttaaaaccagcccttttggcaggctgcgataccgctttcccaaaaggtatcccatgtatttaaagccgctctttacgatcactccgggaacaagccagggctttccctcctttataagccatgcagaagtctttttcacaagacggatcccctcgccttccgaacgaatcccctcaaatacctccgggtggtccgcctgggataccgccagatcgaaattccttttaaactgatcaatgcagccataattatgggaatggtacacctttgcatcggctgcataggcaaccgcctgcctccggcgccttaccgcatttcccgcataaatcatgtcctcattaaagatagttcttttgataaatcctcctgctttaaaaaattcagtcctgtcataggcgcagcagacgttggaagcaaaaaaggtcttgatccccagctgctttaagtcttcaccggtctttacccggctttcctccggatagttaaaggaacgggtatactgctctgccagggcgcagtcagggttaggaagctgtcttccataggccattactaccttttcaccgccttctcccgtctggtcaaggctctttaccaattctttgattaaatccttatcagccggaactgcgtcatcggtcataaacaccataatatccgcctgggaataaccggctccccggttccttgtcccgccatggtcaaactcttcttttgtcacatgatgtacttctaagttggggacccagctatattctttttccttccaataggattgttccgtgttcatgatgatgatcttccggataggataggactgctctcccaggcgctttaaaagacggtttaaggtctcatccggcttatacaccggaataatcacatcaacggttttctcttgccttttttcttccattgtaatctcctctgccttcccgtaagttaatagcgcagacacgccgtggaacagatgcgtatcagggcatagatgcttacaaagcattccaggtaccatgcactttttcttaaatccaggcttgtgaccaggtgtttatcaaataagaccagcagcacaagaggcagcagggggataaaataccttccctggactcccgttatataggtaagctcccttggcgtccagcctaacagcatggaagcaagaaccaggcaggcacttaaaaacaccagaaaaatcatccaaagcttctgtccccggtcatgggagcctcctcccctcccgccttatcacactgactatcagcacataccaaaggatggaaaggcagaaaggcggcaccgtaaggttcgggtctaaattgcccagaaatcctccaagcatagtggtcagataataatcaaactgggtcaccagagtctcataatagacctggaagatgcaataggggctgtcccacacatcctgcagcgtataccctgccgcttcgctccagcccacatagctttcggtggaggtcgcccacgcggaaagaaccatgcggtttaccagatacaccgccagaatgacagcccctatgacgctgatgactgagatccagtaatgcttttcagacttaaacttggaagcggggataaaaagacagattcccgccaccggaagataaacgatctttccaggctccagaaggatcagcaaaagggccagtataaccgtatcttttacggtcactttctctttttcaaaggccagaaaaaagcaccatgccagaaacaccatggacaggccgataaacgccgtatcataggaaaaggacgccgcaagatgaagcgtcatgggaagacatgacactgccatgagaagttcttttttaaagggcatgatccggacggacagggctgccatagctgcaaaagccagaagattaaacagtctgccaagatataccagtgggatgtatcccaggcggagcagcctggcaaggcttatcccaatggcctggggaaggtaaaccaccggtgtggtgttcaccggtatttcataacggaccgtcattccctggctgttgtctagggaaaataattccgtaaggaccagattgtaggtagtcctccccacttcggtataaagcccggtcacgtcgtctccgctacgaaccagaacattggccccgcggccgatcctctctttctcttcctccgtcgcatgggcaagaaaggcatcatcagccactgcagcttttcccataagctggctggaaagccggtaagcgctgacaaaatgggccgactcatcaggagtggaaaaaggagtcagaaccagcatgtaaaacagacccaaaaccacaaccgttcctggaaataaaaggaaaggctgagtcttaagtatccacaaagctgctcccagacacgccagaaatccacagccaaacacaattaaccaccagtaaaagcggcggaccgcttcaaattccggggaagggatcctcacaatagtttccatataggttttaatgaaaagaaaggcgagaaggagaatggttccccccgtaagccataatccctttttattcagaatgagcttcaccatatccttcctccttctccctggcctcttccctgtccagagcgagcatctggatcagctccgtcactctccgctccagctgggatattttgatggactggaaaaaaacctttaccagcaggatgaagatcataaaagtaaagataaaattggcagtggaataagttcccaccatccgggatatgaaatcagccagccgtggaaataaactgaacaccaccaaaagcagggcaaacatcacccagaagatggaatcctctatcttcatcttagaatggcgtattcttctaagcacataaaatgtgagcaatatggaaacgcatatcagcacgctgcgaagcaaaaccgtcatgttacgttctcccttctttatctcctgtccctaatacggaagctttgcaccagcaatatggaaaacagcattttccccatataccgggccgcattaatcgggttcaaatagctctctcccagaatccgttcgtccatgaccaccggaatttccgccacctttgcgccctgcctgatcaaataggaaatagtatcaggttccgggccgtaattcaagccgtcggcaaattccttgatcatcttcctgctgaacatgcgcatccctgaagtggggtcactgacctttacccctgtggtgaaccagatggagccgcttaatagtctgcttccaaacatccgcatggaatggggctttttctccgtcacatacctggaaccgatcacaatgtcatagccttcatccatcttctctctcatgggctgaatgtattccggccggtgctgcccgtctccgtcaaactgaatggcataccggtatccccgccggtgggcgtatttaagcccggtctgaaaggctccggcaagtcctaaattcataggcaggtcaatgatcttccagccatgctttctgcagatatcagctgtgtgatcggtggaaccgtcattgatgatcacgtaatcaaacatgggatagttctcaatgacttccccaccacgcgctcaatatttaacgcttcattgtatgcaggtatcactaccagtaccttatccatcatttcttttgttccagcctcccattttcctctgtaccgcccgaagagcgttcctctgtaattaatatatggaccgcctgtcccataaagcaaagcatgagaagcagcatttccagcatgtaggagaaggcccctccgttgatcccgccctttcccacaaaccagaaggagagaaagaaagaaaggatgcaaaccggtacatatccgaaaaagatccgcttctgccttttcatgatcacaagcacataataaaacagattcataaccgcaaagaatccgcctcccagcacaatgaacagaagtcctgaccgatagggcttaagctccacattggaaatggcacccagcacaggcactccgatcgcccaggctcctgcaagggcaattaccgtaagaaaagctatgataccggaaagcttttttaaaccggacttaaattcctcaaagtttctttcctcccactggtaagacatccttgttaaaaaaggacggattacaaaattggccgccaggttgatgaccgaggtaggcataaaaatagccacaaaaacggcattgtccgtggaagtcatctgggcatccacagcatattttgccatggcaaaaatgagtccgtctaaaaaaacggataaaaacagcaaaaatccatcctgcaaaagcttccactgtctgccgggtgtcctggtaaacacaattcccggaacccgctctgccgcctttttatcgaacagcaggatccctgctccctgggacagaaccgcaaccacacaggagaacaaaagctcccttgtaacagcaagggtaccaagaaaacagcaaacagacagcagagtgcggaaggccatggcctgtcccgtaagatagagccgcccatttctctggaattccgattcatacacatcggcaaacccatcaaggaccttatacagtaccatcaaaaataccaccagcgccttttgggccgtgtaacccgccgaaggagacaggatattgaagataatatagcacgttccgaaaagaaccgccgtaaggcaggtaacgaaacgggccagacggtattcggaaaaggtatagctttggcttgtatccgtactctgtaacggcctcatgccgaaataggccaccagaaacatctgctgcccaaaggtactgaaagcaaagccaaagatccctccctgttccgttcctaccaggtgattgacaagggccgttaagatcatgctggaacctgcataaaccaggctcccgatcatattccaggccacattttttcgttccatttattttcccctgttttcctcttattacccgcgctttttgggcatcaaggtatgcccgtagggtatttcctcttattgcccacgctctttgggcatcaaggtatgcccgtagggtatttccccataatattcctttattctacaatatccagccggaaaagtaaacttaaaaccaccccgcctactgctttatgattcctgaaatacggcacaggtacaagaaggcctcaagccggaacagccaggaaagccctgcatagacagcaactcccacaagaatctggacaataagggttaaaagagttccttctattacatactgtatcccatatgaacataaacacatcaccgctgataagagaagggagggaagcacatccttccactgttctaaaaagctgtagtttaaaagctttttattggggtaggcattaataaaggtacagatgaaatcagtcactgctttcaaggccaccatggtgtagatcccaaaggggatgctcaccagaagcgcaaccacgctcaccgccttctttattatttccagtttcaggaatatctcactttttcccagggcattgatagcctgtaaattggccacatgaaggggccaggtggcataggcaacacacagcatccggagcatgggaacgcagggaagatactggtccgtcaaaagcagctttaccatagcctctgccacggcgatcaaaccggccatcatgggaaataccaggtaggaactggtgacgatggaccttctcaccatgcgtttcaccctttccctgtcttcctggcaggccgaaaaagccggaagcatgaccgactggatagcagctccaagattattggcaatcagggcaggaaactggtttcctctggagtattgccccatcatggcggaattatatatttttccgatcacaagcccgtaaacattgttaaatattgtatcaataagtccggagcaaagtattttccagccataggaaaacaattctcctgcctttttaacagaaaacagaagccttggcctccatttcactaaaaatgacagcatgaccattaagaaaaagctgtaaaaaaactgctgcatgacaagagcccacagccccagtttattggccgccagaaagactccgatcacgccggagcaaagggccgcaaacaggcttgcaagacaaagcttccgaaactccatgttcctggcaaccacggcagactgtacggaggtaacggcaccaaaaaacaaggtcacggaaaggaccttaagcaccggcccaaaaacaggctgtccgtaaaaggaagcgatggccggagccgagaaaaagagaatcacatataagacaaaagcaatggcagcgctgatataaaatgcagaagaataatcagcctcatccaccttttgtttctggatcagggaggtattaaaaccactctggacaaacacatttccgatggtaatgaatatcatgatgagcatgacttctccggactctgccggcgtcagcatccttgcaagcaaaaccgatacaaggaactgaatcccctgtgtacccccgttttccatcactttccagaacagtccggaaaggaccttttttttcatattttcctggtacatactggcttttctccttgctttaccaattgacatttccgccttattgtactatattccccaataattgtaaatcgtctatagcattttggaattaattgtgttagagtataaacgaatatactttctattttaaagaattcaggaggtttttatttatgcgtaaactgacacgcagactgacggtactctgcctgacggctgctcttgtttcaggacaggcttcccttgcatgggcagaagaagcatatggaccgggatttaaaaatggtgtccctatcagtcagagtgacggccagtctgaaacacagagccagacgagcaaccagactcagggaagcacagctacagaagaagcggaaaccgctttggcaaatgccggcatagacattggaaaagaaggggaaggcagcggggaagacggtgtggtggacgaagcaaccagggccgcccaggaagcgctaaaagcaaatttcccccgacttcagactacggttatgatcggtgacagcaactggtcacagccatttgtaaatgatgcatggatcacaaatgacggacaggggttccacggattgtccacctttcttactaacattgtaggaaacgtgcattaccggacctatacctccagcaccggatggtctccatgggttttaaacgggcagcagactaccaactatgccaatgacattaacatagaagcagtgcagatgcggttctccggttatgtaaataaccagtttgatctttattataccgcacagctggaagacggaaccaccatggactgggctaaaaacggaaccaccacagggaccatgggcaccggacattacataacagggcttagaatggccttttacgccaagaactcccaattcccctatgcaacggaaaaacctgtaatttccgcagttgctgacggtatgcggcagattgacggcgggctccggtactttaacggagacggaacctcctttaccggatgggcatgggcaggcaatgaacgttactatttccaggattcctatcctgtgacaggttggcagtatattgacggctacaaatattatttcgatgaatccggaaaaatgctctctgacttagagccgatcattggagcaaaggggccgtatcttatcagcatcaataagacaatgaactgcatgaccatttttgtcaaagacggagacaacggctttattattccgttaaaatcctttttgacctctaccggaccggacactcctcttgggacgtaccagactccggaaaagcaccgctggagagatatgaaccacggaatctttacccagtacgcaacccgtatctggaaaggcttcctgatccactccattctatacagcagtcctaacaacatgacgctggatccgacgacttataattatatgagcatcgcccagtccgccggatgcgttcgtctcctctccggtgatgctaagtgggtatacgaccactgtcctattggaaccacggttacgatttacgaatcaccggttccgggaccttacgagagaccggctattgaacaaatcatacccgaaacccagacctgggatcctaccgatcctaatgttgcacggtaattgggttcgtaaaaccttacagttaaaccatgggcaggaaccgcttgtaacggatcctgcccatggttttgttttcctacactttttttccaagaaacagctttcttaacagcctgtaagttcctggggcacggttctcagcctggataaagaacctggttctcggtgtcagctctttgtaatacttacggtactccggattcatgatctctttaaactgtctggtattgaccatggtatgataataagtccgctttgccgcgctttctgcagcttcccttaaacgtccttccgtggcagcgtcaaattcctcatacaccgttttcatccgctcccagtaaatcttctgctttctggcgtaatccccgctttttccctccgtagtccaggaacctgccaccctacccggtaagcgctcatggcctcatccatgtaataaccgtaaccttgtgcagctgccatcatctgcagaggtgtgtctcccacaggacaatccacataataatccggaagctcctttaccagacgggaaggaaaggccatggaagacatggcgtaaccggaaggcttatccacgatctcctccggcgtaatcacccggtttccccggtaaggacgcatctgaccttccgtcaaagcccttcccaccagatggatctttgcactgtgtatgcaaagggtacagtccggatgagcctctaagtaatccacctgcttttgcatcttatccggggaagtccagtaatcatctccgtcacacatgaaaatatatttgcctcttacccgcggaaaattaaaggcaccgctgatattgtcgatcccctgggaatactggttctccttctgtatgagcggtttcaccttatccggatatttttctccgtattctctcagaatatctcccgtctcatcggtggatgcatcgtcatggaccagaatttcatattcaaagtttgttttctgcatcagaaaactatccaaggcctgcctgatatatgctccatgattaaaggtcaggcagcttatgctggccataattttcgaacggtcaacgccactcattcctctccgccctttccttcatttacttttgtaatatattcctcatattttcttgcaatatacattcctgtaattcccctgaaaggttctatggcctctccagtaaagcatcttaaatgattgatgacacagtcatatcccgccatacaggaaaactccacgcctccggaaaaacggggattgcattccagcatgtgatacgatccatcttccccctgtatgaattcaaaattcacacatccattgatattaagggcatgggcgatctccctgctcattgcttcaagacggggatccgaaaatacaagaaccgaggttcccgctccgttaggggtccgcaaaagctccttccggcagacagcccagcactcttctgtttccgcctgcctcaccacatccacggtaataatgcttccctggtaaaaaggctgtacgatcagcccttcagaatttgcgctttccaaaaatcccttcatctcttcaagggaacgaatatagcgaagcccctgactgcttcttccgttaaagggtttgacaaccgccgggtaggtaagtccctccaaatccgcttcccaaagctccgaagtgggaatcggatttccaaggcctttttctgcaagaaaatgatacagcctccttttatccctgcatataagaagggtttcctccgatgacaggcacaaggtcaccgaggcctttgaaagctcttcccggcggcggttccatacatcagcctccacatccgtaagaacgatcagcatctcaaccccttcttctctgcacacctttaagatggagtccacatacctattctcatcagtcgcaaggggaacctggtaaaaagatgccacacttcctgaatccgcgatccattctcccggataaatatcacagccaaccacccggataccgcctttttttaaattcttaatgacaatatctgccgaaaatgacccgatcgcggtcaccagtgctgtattcataatttcctctttcctgcccatgatatttgggcataaaggtatacctgtaaggtgtttcctctttcctgcccatggtatttgggcataaaggtataggtatcttctagtattccagcagataggtcacggaaagctcctgggcaaacacacatttcaccgagataagccctgttttttcacaaatttcccgcaccacttcttctgcatcatagccgctgccccagaaagcgttgttatccacggtaacaagcattccccggctcacatcccttccttccaggatctgatccgcatctgcaaggccctccttgcttgtcacataaaactccctgtaacaggaaagtgtccttaagtcctgggtcagagccgccatccggtaattggtcacgtacaggcaggaaagatctccatatcgttttgcttcctcaagccttaccggctcatccctgtataaatactgtacaaagccgttacggtaagaggacagggacaggcacaaaaacaggaccgaaagcagggccatcaccaatctcatggcaggctgaaaagcttttgtcattcgccacaaaagccagatcccggcaaggaccagcaatgggtaaaggctgcaaatataacggggagacggaaccactgccacggaagcgatggtcaaaacagctgcaggacaggaaagcaaaaagagccagcctcccattcctttgggcttatccatgaccgccccttccttcctccttcccaggaaaaaggcggcagccacagctcctgctgccaatatcaggatcacaggaacagccttgtaaatgccggagagaaaatccgaattgattccataggcataagattttaaatttgtgatcagggtatccagattgccgatgttctttttcgtttcctgggccactatttcatcgtccctggtgagctgggtaatgcaggcaggaaaaaggacaaccgccgtacccacagctccaaaaaggacggctgcatagagaaatgcctccttaaaggccctcttccaaagcttccacaggaaataaactgcggagaggtaaaaggcaaaaatcacaaaataatattgagtaagcagcccgcagattgtcacaaggaaaatcagaatcagatctctccaactttgtccttcctcctccatcctttcgtgcagatatccgcttagtacagtaaaaagggtcattgccatatacatgcggatgtagacggtatagctgacggcacctgcagaaaatccccagataaccacaggaacaagaccaagccaggaacttttcataagcctgtttccaaggagccacaggaaaatcccgcttaaaagaaagcacaccaggttgatccctatgccaaaccacttggaatacattcccggaaaaaaggaacagaccgtgtggaggaggaggtaaaacacaggcggatgcacatcctgactctgattataaatgacagagccgtatgcaaacccctctcccttttgtacggtcatgtaatcatttatgaccgttttgtctgcccaccggtcaaagatctcatccccataggaagtgataaagggcttataatagccgttagacagtccgaaagaataaatttcgtcaataaaatatcctgcttctggcttccgaaccagatcataacgcctgactgaagtataagaatgaaaatcaaagccagcaaagcccttctcttttcctctttccgctgattcatatcttcctcctgcctacagtccggttaagggggaattggcaatccgatctgctgcctgcccgccaatccgtgctgcgttcagataatcaaaatacagaggggtcccgcctgtatggataaaaagaacgttctccggttcgtgagaccttgtttttaaatactttaacatgccggaaaaagcttttcctgtataggtcgggtccaaggggatgccgaagcgttccatcatcaagcggatcacggattcaatgtccttgtcataaaggccatagcctccgcacacgtacccatcctcaaaatgtacgtcttccgggccggcccctgcaaaccgggccacctcgctttttccccggcctgacgggcgggcaacggaaattcccgtgatatctgcatgtcctccatactgattctgccctgcaacaaggcctccctgtgtcatcccggttccgctggctaaaaagatccggtcaaaaacgatcccctgttcttcctgatactccagcagttccccatagactttcctgtaggctctggcagccgcttcctcatttcccattccatagcggtctccgaagacataataaggccggtatcccatggatttcagctctgccataagctcatccacaccttctgccacgttatctttatggcagaaacggatgtgagcaccaaattcctccaccatcctgctgttaaaggtcccttcttccaccacatcttccttggcagtgagtacgtagcatggaatctcatatctgctgcataaattggccagggcacggcacatattggagcggctgctcccataggccaccagacagtcacagtctttttccttcatatcctggtaaaattcccaggcgatccgcaccttattgccgccaaaggaaaaccctatgagatcatcccgctttataaaaatcctgtcgcctgtatctggaagcctgatctcctgtacaggagtcttaagcattacatcgttcattgacccttcctttctctcttcctatctggcctctaaaataatgccgcagatacggtccacctgatccaggggaagccctgcgtacaaaggcagagtcagaacgctgtccgccgccttttttgcaaccgggagggatattcctgaaaattgctcccgatagcattcaaagtctgtgatcagaggataaaaatattttctggcaaagatatgatgagaagccagcagctcatatacctcattccttgtcagagaaaagccgtcaaatgcaacgggaaaatacgcataattctggcggatgccttctttcggctccatcacccggatcccgggaatgcctgtgaaatgcttccggtaccgttctgtcaccatcctgcgcttttcaatgttgtcatttacatgacgaagattgcagatacccatggccgcctggaattcattcattttcgcgttgccgccaatgtactccacggtctccttgccggtgatgccgaagtttttcaaataattaaacaaaatttccagagacggatcctggaaggtcacagccccgccttcaatggtattatacacctttgtggcatgaaagctgaacatggaagcgtctccataggtcccgattccccttccgttcacctccacgccaaaagcatgggcggcatcataaattaccttcaaattatgtttttttgcgattttctcaattttatctatatcacatacatttccataaacatgaaccggcaaaatggcagcagtcttgtccgtaatcagttcttcgatcttatccgcatcaatggtatagtcctcttcccggatatcgcagaataccggggttaagttatttctcacaatggcatgggtggtggaagcaaaagaaaacggagtggtaatcacttcgccagataaattcatggcctgaagagccatctcaagagccatatgcccgttgacgaacaaaagcagcttctgtacctttaagtactcctttaactgctccatcaatttttcatggaattccccatattcgtcatccaggcggtttcccagatcgggcgtatctcttctataaactcttcataggaaggcatggacgccctcgtcacgaatatatcctcttcattgtccatgctttctgggcacagcgcccccgctttatcgggtgtaggggcatgcctgcaagatgttccttctcttctggtaacataagccaaatatcctccattttccggtcagatggaaaacatctggcccagcgtcctcattggggtgcttttcattagtttgtatttccaaatgatataaaccttttccgcccggtttttcccgtaaagtccgataaaatgctccaacgtctccctgttctcccgggacatctcattttcgtagagctttaaaaactgctgcgcctgaacaagcattctcctgtagttttcccggacagtgtcctgattcctgatccgctccgcatactgctccttaccgcttttcgaccccacctgattgtccccgtgctgccggtaaaggaccagaggccggtcaatataggatatccttccaaaacagcttgccagaagccctaaccaccagtcatgcatgacgcactcctccggaatatcattcagcagccgcagaagcgctttattcaccataaccgtatttccggtgatgttgttctccaccagataatggctgaaccggttgtcatggaccgcaattttctggtattctgccatggatttatggagtaccttaccttccttatcggtaactgacagatccccatggaccagcagcgggaccttttttccccattccgcttccagcctcttcatttctcttaaagtaacttccgccttatccgaaagccacacatcatcctggtcacaaagcataacatactcatcggtcgctgattttaacaggcggaagaaattattctgagcgctgccggacctttcaccgttcctaaggcttttcaccctgcccggatacctttcctcatattcctggataacggctggagttccatcggcagaaaggtcatcggaaatcattacagtcagatcagaaatcgtttggtttaaaatggaatccagctgatcccgtatatatttttctccgttataggatgccaaaagcaccgacaccatatgatttcctcctttcctctttttgacccacaaatacaaaacctaccaggacaatcccagaattttcgttaaaaaccagatttcacccatgagtaaacccagaaaagcctttaccaggcattcctgaaaccggttaatttccagatactttttataataatgaagcttgctcttatgaagaatcgcctgttttcttaaaatagatttcacacttttatcaatggacacggaatgaagatgcacataagactgattcaaaagaagcaccgtcccatacccttttttcttcagctgaaatcccagaatcttttcttcataatatagaaaaacttcctcatcataaaggccgcattccatcagggcatgaatatccgccataaaaagagagccaaggaccgcatccacgtaaacgtaatgctctttctctttttcctgaccggctttttttgcatcctggtattcccccgggctgttcccgccctgcggcttatttaaatccgcctttaattccggccgctcattaagccagtgggcgaaaagccgtctggtaataagccctgtatccagaaggtctcccaccagaccgttgatccgccagcttgacagggcaatagctcctgtcccatccctggttactgccgcagcaattcccagcctgcttattttcaaaaaagagtccttcatggcccggatgcatccctcagaaaccttaacatcagggtttgcaatgagcacatgggtagcatgaagcgtttcggatgcataccggattcccagattattgccgtatccataccccccgttcctttcggataggataaaatggacctttccgcctgcaattgctttaagctttgaaggggaatcatcggtggaacagttgtccacgaccacaacagaatccagaatttcgtaactcactatggaatttaccaggcctatggtggtttccgcgtcattataattgagaatgatacagctaatgttcatatccgctcctcattaagaaccctttctggaattgatcacctgcatcccaaacctggcgctcacaaagtcccttacaggggacatacaagggtggcgtaatccatcagatgataggcagccatataaaggcggcttcccttttccttaggcgccccggcccatgggtgagggagagataatgatcataagccctgcggtaatggtttaaattcccctctttccagggcctttcatcccccataaaatgcaggatggcggggtgcttttttgcctctttaaagctttttgacctaagcttcccataaacaggagacagtcttaccaaatggctgtaccggtaatagcggtaattggtgaaaaagttatacctgggagataagggctttatccgccctttcaacgctccgttaatggtatcctggtctccagcaaacagctttccgcccttggaacaataaaaatccagaagcagcttctgggcattctcttttctccagcgcatcatatcaatgagaaggactccggaattataataaggctccgatggtaacagaccgatctcttccttaatagaaggataaatggtaggctccatcaccgcacctaaaaggaaggttttcaaatccgtttcccacaacctttttaatgaggaaagcaccacagtatcacaatccagatacagcacccggtctgtttcctcagggagaacttctccaatgaacagccgggccataatgcttaaatcaaagcctcccgtatccacttcataggaaaagcgctcctttaaatttccaagctctatgaccgccagctcccgcctgaattcatccgtcaccttcttaagctgatcttttgtctccccggacaggttcatggacaaaacgtatacatggatgtcctccatgtccctgttgtgatccagaagggagtaaagggatacggccagatgtctggcataattgtcatttgaagcatatacaacgttcataaagtcctccggtctcattccatttccgttgtattgtactatatcctgcataaaaagtaaaccgcctggggttcattgtatcattcgtttatcttctccataaatgcctcatagctttcagatttcatcagacaggatattttctgataatcatttgcagtacttcccagccattcgaaaaaagtactcagattatgtctcccattcttactaatcgcgggcatcagaaccagcttgacagaataatctccccacttaattggtttttcaagtatccccaccgcgattttcgattcccggctctgcaaaaaaatgggatggggcacagcgaaggaatacacaaaagatgtgggagacatctgctctctttttataacttcttcctgaaacgtttcatccaccactccggcctgtaccagtttctgactcagaaaaccaatcacctccagcggagtcttgaaatccaggcccgtaaagaacaaccgtttttctatgatacaggcaacacctctggtaaaatcttcctgatacttcttctcatccagataattcaaagcctgaaatatctttccttcatcctctatcctcacaaaaatagaaatctgtacagtaaggatatttaagtcatgctgaagtggaagagtcgtcagaatcagatctggctttgcattgagtacctttttcctttcaaaaaaattgtgacagtctacaatgtaaatccgttcccggaatactttttcaatcttatcaacacacaaactggacaaagcctggtttataggataaatcatcagtacccggtatttcttcctgatctccctcttctctaaagaggcaccgatatactgtgcaagataactgatatcatcttcatcaatctttatctttttcttctcctgtattactttaccggcacagattgccatttcaaagattttaggatatttccctttgatctcacctgtataaaaatcagaaacatctattttctttcgttttctgacaatcatctgcaatacaagtgctccaagtctcaccttcagttcttcatcatcgcataaattcgtattaaaatttctttttatctcctgtaaaatatcttcagcaagcaaactcaggtccggatccggattgccgatcctgtcctgatcctccagaatcatatcttcctttttaccgcaatcagcgatgccagatatataatttctccctcgtatttcccaataataaactgacgctccatttcacgaaagaaatcttccgccatccggtattccaatggaaacctctttttcatgtctttccagccttctacctcctctttgctgacgtattttccacgaatcatcctcttcagacttgttgctacgcttatgagtaatttgggaatttcttcttttcttattctatatttatacttttcccataacatactaagcttctccgatattatggaaacaggaattccatcaaactccttactcaggctgtcaagattcagaatattatttttacgcttgtcaatgatcaaatccctgtaaaatattcttttctcctgttccgttccttccaggctgacacaattttttttacgcagtatttttatggattcatatgtatcagtcagctttttcagttcccgcaactccttttccaatgtattctgactgatgcataattcctctgacaactgaaaaaggctgattttatccgagcagaagaataatttttttatcacaaaaagacaccgctgttctgtagtctggggaatccttatttcttcacttcccttatactcttccagtgcacgaaagcaaaatcggtatccgaatttaatatttgactctattaccgccgtttttctgctgctgttgatccgttcaatatcataacgtatggttctgtcagaaacattaagaatcgctgataattcctgtccggttttccactttttctcacttcttagcaaagaaatgatcttttcctgtctgtcgttcaacataaccccactccccatcatggcaccctgtttaaaaccaaccaaagccgtctgcttccaaacacttgaaaacaaacgacttttttaacgacgttgttaaatatcttttctggtttttctgttctcctgttccagctgaaagtattcccctatttatatacttcgaattgtccagcctcttcatccggatcaatcacaaatgtgccatgatccccatccacacatgccggttcctggtccctgatatcagccagatcgaaatccagtcctaaaactgctggtatcttcagcattctgatcagaattgcagtatgggaattccggcttcctcgttttgctgcaaatgccagaaccatatctctatttaatctcattgtctggcttggagtcaagtcttctgcgacaataatagacggttcctctaactgcacatcattttccctgttagtcagtacttctataagttgtctggatatatccacaatatcaattgcccgctccttcatataatcatccggcatctggcggaactcttctgaggcaactgcttcagcagaccggactgcttttactgcactttctttctccccctctatgcattgatagatctgttccaggtactctctgtctttcagtatcatccggtgcattgcaaaaatttccgcattttcttcaccggctatttgcaatacatttttatataaaagctccagcctctggtccaccatgcaaactgcatcctcaatccgctttctctcctgtgctgtatcagtaattttatgtagatcatcaggaatatatattctttgcagcttcttgatcttaccaaccgcaatcccccctgatgtagcattaccataatactttttcattctatcactccctgacctcattacagactttcacaaaaaaatgtttcaatttctttctctgcaaattcttcgtctggtccgtctatctcaacagtaattgtatcgcctttttttacacccaactgcatcagggcaagaagatgatctgcttgtgcagacttgtctccttttatgatggcagcctctatattatatttttcaaggatcttcaccaggttactgacaggtcttgcatgaagccccagctgatcctttatagtataattgaattttttcatcgttcctcccaactccggtttctgtgtactattccttaataaatccaaataaatattccggttccagcaaatctaacagcattctttcttcatcttttactttgccaacgtaattccaataaggctgtaagggtatttcttttttaatgatctgcatctcacctctgtaatgagacaaacggtcattgactatcactatgtcacctggctttagcacagtcttggtacattttctttccggtattcccacattcctgaaatcctttcttcccatactgctgcggatgaaaatatcggaagcatcaacccggtcgaagtgggaataggagtataagattctctcctcttccggcagaatatcttcttccgtttctatgcgtaacgtgatcctgcttgtatcaatccgggacagtgcccgtaattcctcttcagccgcaaatgcatttccgatcaatatgtcatcgatttttccggttgccagtaaatgtctggcctgcaggtcaatgggcaggcctctgtgaatttcacaggttaccagcccttcatagacaggccaagggccaaaggtgccccggttattactggatacaaacgcagaaacgggcattcctgaatttttatactgattggtaaacttcatgaaccgttcccagcccagaccggtatacttctgcggataaaaattatggcatgtgaccatattatgtatatcagcgccgcgctccagcatcagatccaggcttatgttggagctggcattgaactcaatagcgattccataagggttgtgcgtcagggcaatatcctcacggtcgctgaaatgcccatccagacggatgatctttaccccatatctgcaaatatctttaaatcatcaggctttgcgttcaaataggtaaatacttccgggttggtatccacaccaaccgtaaatcccaattcagctgccttcctgatccagcttccgaaatgatccacaatagtctgtggaggttcttctactgacagaaggcaggtaaatattcttgtaaaaccgtattttgccgccaactctatgtaatccatgtccttttcaggtgtagaatgttccggataaacggatataccaaatctatgcatgtgtattcctttctaataaacataatctttgtactggtcctttggtactgacttctctgctaatatttttgccatactgcacatgtttttcaggcttttattcagttctgtttctccctttttggggcatttcacaatattcaccttttctttaaatgcagcaattacctcttcgttctcctttgccatggaagcaaaagccggcactgatgtccggtcattgatcccgtaagccaattccgcacacatctttgcataatccttataatcaaatgcaggtccgcaaagaaccacatccggtttgatcatttcgatcttattgcatattttgcggctgatctcctggccgttttcaaaataggttcctgttccgcagaaaaagcaggctataaccttctcgtcatattcctttagaaatcgctccatcatgatacttggccctatgggcacgtttttagctccaagtgggatcatagtatctgtttttgtaccaagtccggcttggatctgatcataaatcataactatcttaatcataacatactcctaatcatcaaaggacagttcatccagtgatatttcttctccatcggctttactgcctgattcttccatgatataattcttatccattgattttacaaaaggcatataaatcattgctcctaatgcgatcagtactgtctggagaagagctccctgccacccggaagacagaaatcccgaaatgataggcggtgtggtccatggcattacaaccccgttgcagatcggtacgatgcccatgctcatgcagaaataggtgacgataatattgaacatgggaacaattacaaatggaaccgcaatcaccgggttcaaaaccactggtaaaccaaaaataattggttcattaatgccaaatatggccggtataatggacagttttcctaactccttgattctttttgatttgcagaaaaagaacatgataatcagcatggatagagtggaaccaccgcctccataggttgcaaataaatcctggaactgaacattgataatgtgcggaagctcctgtccggcctgcaaagcacttagattttccgcagataaagcgtataaaatgggacggaatacagaatctgtgatgtttgttccgtgtataccgaaaagccatagaatgtgggcaaaaaagtagactcccagcatggccccaatgaatccccaacctgttgcagcggcatctgaagaatattaaaaataaaatcaaatgcattgttccagggtgtaaatgaaaaaataatatgaataaccaaaaatgctgctgctacaatcgcggcaggtaaaagagctgcaaatgactgtcccactgttggaggcactccttttggcatacggatgacccagccttttttttcgatccgtttatatatctttaccgagaatatagcacataatattcccacaaaaataccttttgacccaacccagtttaggggaatgcttgcaacctcatagactttttccgatccttccggaatgaaagaggtggtcagaggcatcagcataaaccagcccatcagtgcaactgccgcaccgaatattttgtttgtctcctcatactttgcataattatatccgatacccataacaacaaaaacagccatcaaagagaatgtggcgtctgttactaccgataagactgatgatatagattctccgctgatataggtatttttcagcaaatcgatccatggctgaatcggaaagtttgcaatcagcataaagaatgaacccacaaccagcagaggcatactgatcaaaaatccatctcttatggacagcagatatttgttcttacttataacctgggcaacgggcattaacctggattctaatttttccattaatttgttattcatattttccctctccttatcttgttttgatgatccttcctgttctatgaaattccccttttaattaatttaactgcatattttaatacagcttccccattcatcattccgtaatcctttgcatcaattacgccgactggtgtattccttttttcataaatatttttggtgtcagaatacagaaatttcacctgcggccccagcaggatacagtctggatgcagtttttcataaatctcttccatttttgcgattgaaaaagccttcacttctaccggtatcttgtgttcatccgcgacctcctgcatatttcctgccagcatactggtagacattcccgcactgcaaaacagataaatccgcttcatttccccacctctttttccagttctgataattttccatagacacttttaaattccataaacaaggtcttatataattctgccgccatcagctgatcctctgcgtgcatcacaagaaccatagaatttatggattccgccgcatccttcagcgccagcaattcggtatgcgcatcatgcccctgcacatagcttttttctccttctttcaccagctctgttgcccgggaaatgtccccgttcttaatctggctgatcgcttcgataaagtcagactttgcaacccccgccgctgaaatgatctgaaagcattttaattccagttcctgcatcttccttaccctttctgttttaatgataaaagtataacttttatatagcccttatgcttacccattgttttcccctcactaggaaaaaaaagactgctgttttccggttcagcagtctttcttgcaaaatttttacattaattcagtttttaccttatccatggctgactcaatcaccttgtccatatcataatatttatactctcccagacggccgccaaaaattacacgcggctctttatcagccagagcagcatactttttatataatatctggttcctttcatcattaacaggataatacggttccatgccttccagccacgtttccgagtactcccgcgtgatcacagtctttggctgggttccaaactcaaaatgcttgtgttcaatgatcctggtataaggtgtttccctgtctgtataattgaccacagccactccctggtaattgtccgtatctaccacctgggtttcaaaacgcaggctacggtactccagctttccgaactgatatccataataagcatcaatggttcccgtataaatcacccgttctcccagcccgtcataatattctttattttccagataatccacacccatttccacgtcgcagccctcaaacagcttttcaatgatcacattgtatccgcctatgggaattccctggtataagtcattgaaataattgttgtcataggtaaatcgaacgggaaggcgtttgatgataaaggcagggaggtccttgcagtctctgccccactgtttttctgtatagcctttcaccagtttttcataaatatccctgcccacaagactgatggcctgctcctccaggttctggggttctccggttatggaagctttctgctcttcgatctttgcctttgcctctgcaggggtggatattccccacatcttgctgaaggtgttcatattaaagggcatgttgtacatttcacccatgtaatttgccaccgggctgttggtataacggttgaactctgccagttcattgacaaactgccagaccttcttattgctggtatggaaaatatgggctccgtaacggtgtacatggattccttctgtttcctcgcagtaaatgttgccgcccatgtggtcccttttctctaccacaaggcacttttttcctttttgccttgccaggtatgcgaaaacgccggaatagaggccgctgcctaccaatacataatcatattttttcatggtttctttctcctgtctcggttataaactgtctacattatactaaaatcacctggaaaagtaaatgtatgtgcttatttacttcatcaggatcaatatataagaggtttatttgccaattctaggttattggaggtagaatatcattatacttgctaaattaaaaggataatgctttaggaggttgaaggtatgtttaaagtagcaatttgtgatgatgaattgaatgaagctgcggtaattaaagaacttgtggaagaatttatgaaagatcatggaattctttacagcattcaagtatttctttccggagaggaactgataacctcctctataaactttgattttgtttttctggatatatctatgggaggaatgaatgggatcgaagcaggaatgaaactataccaaagaaacagaaaaatcaggatcatttatattacaggttataatggatactgcaatgatgcaattaaccgtgcacatgcatttgcctatttacccaaacctgttgaaaaggagcagttaataaatcatatcagtgaactggtacaagttataggattggacagaggaaatgatatagaaattgtgttgtctaatgctacagaaataagtaagagtggaaaaaaagaatacccggcaattaaagtaactgtttcaaaaatcctttattttgaatatgtaaaaactgcacgtaaaatcagagtaaaaacaacaaaaaaaacgtacgagtattttgggacgatagcagatgtggagcaaaggatggaaatatacggatttggcacctgctaccgtggggtgattgtaaactttgaacatgtgtctaaggtaaaaggggatatggtctatttgaatacgggagaaatattaccattatcacaaaagcgcgtaattgcctttaaagagcagctaaatgattatgttcacaggagtatttaataatggaaaataacatattgtttttatttggaatcataatatcatgtctggttacaactatagtaatatttcaatttataggcagcaggcataaaaaagtatttcaaaataaaccgttctactttttggttcaaatatccgtcagtatatttttaatggccatcaatttgttgcagcagccattggttaatatgcttagttgggttgtcttatatggcttagtaagttatttcttatattttgatgattttgataaaccgatacgaagggttttggaagcggaaataatggttttggtatttgcagtgtgcgaagctgtaggagtaactttacttgaatttatattctggaaaatgcatatgcctcttttggagccagaggtgaaaaattttcttaatatgacattttcaatgattgtacttttgtttatgtattatatatttatttctcctatatgggggaaaaacgagaaagtcaaattcaccaaaactcaatatatacttcattttataattactatttacagttttatgaacatggttgtaataggcgtttcatatggaaaaatcaagggcgagagtatgagttttattttgctgatcaacttgggatttataatatttgcagatatgtattttttatattttatacgatttatggaggataattatcagctaaaggtaaaattggaattattggaacagcaggcgactatgcagtataaatattatttacaccaggaaaagaatcatcaggaatctcttcgtatacttcatgatgtcaacaagcatatagcggtaatggaagggttgtatcatggagatgataaagaaggtacaattaattatattaaagagatcaataccatcttaaaacctttactcccaaagcagcttaccaataatggtattttaaatatcctcttaaatgaaaaaatacaaaatgcaggaaagctacatatagatttacaatatgaaataggcaatgttgatttaagctttatgaatcctatggatattactacaatctttggtaatttactggataatgccatagaagcttgtgaacaagtaaacggctctccatggataaggctgaaaatcagtccttactacgaaatgattgcaatcaaggttgaaaacacttcaaataatatagtcagatggagcgaaggcaggccggtatctcaaaagggagcaaatcacggaatcggattaagcaatgttgagcgtgcagtagtaaagtacgatggttctatgaatcttagcagtgaaaatggaatatttcagtgcaatgtactgataaatatgtagttacatccggattgagcccggattgaccgtttacagatgaagtgcctacctcgtgcaaaaaaactgtctttcgtgttttaaacattgaaagcaggcagcatttggctataataaaattatagtttttaaaaaaaggaaaggaagataaaaatgatgaaaaacttaaaagaaacagcattaactttactttcaaaggcagcattatcaacgtccaaaaaggaggcaaattcagcttgtatttgtatagggtatcaacccaagatgcctgagagcgtcacaaaattcaaaaaaacaattaattaaatttcatattcaataaattgatgaaataatgaaaaaaatagttggctacatatcaaaaagcatggtcaaagatggtattatttcagaatcggaacaggatatctatgattttggtatagaatgtttgcttctaaaaatgatacattatatttcttatataaccattgcagtcatgatgcagcaagtttttgacttatttgttatggcatgtacatttattccaatacgggaaaatgcaggcggttatcacgccaagacgagaacgggctgctacatggtatcatgttttacggttttttccagcctgctgttttacagacaaaatatgagtgatcagatctatattataagctggctgctggcttctatcattatctatctctatgctcctatagataatgaggggaaaatcatgaaccattcagaggtacaatattataaaaaaaagtccagaatggttgtcgtagttcttggagcattaatagggggagtttgggcatttaataaagtatatatcagcaaaatgctgatttgcggacttaccgcttcggcaattgcaatcatagtagaaaaacaaagaaaaaaatgacaaagcggacttgtgtcaataacatagacacaagtccactttatagggatagatttaattgtgagaagtttatcctcattttccccaccgctaaatataaccattcttctgagtttttttgcgtataaatgtctagaaaaaagtccttgagataaatttttatgaaagtaaaaccatccccttatacataactcactgggaaaatcgaattctcctttcaatatcccggttatctgatggaacgtccgggcagaattaacggatgaaaaaagggaatttgttgatgattccaacttccccactggtctcatcaacaaactcctttcctttgctcttatcttatcgtcgtcaatactatttataaggctgttaattatgcctcgtcatcctctccttgatcctcggccctataatctgaactacgatcaccagaatcagaatgatccctttaatggcatcattaattaaggaatccatcttcagtgcaacgatgatcttatcaatgatggtataggacatggctccaaaaaggattcccaggcatttgcctttccctcctgacatgctgattccgcctaataccactgctgcaatggcatacatttcatagctgtttcccgttgtggccgggtcagaggaggcattcatggccacccacaaaaaggaggcaagccctgtcaaaattcctccaagcacaaatacagacactttcatcaggctcacattgatccctgccatcagagcgccctttgcattgctgccaacagcatagaccttttttccatacttggtgctggtagttatgtaaacaaatagtgccgtgatcaaaatcaggatcagccccacaatgggaaccgtaaaaacctttccgtttcccaggccgtaaaagggctggtaggaagacaactccttgatcatccggtacacgctgctgcctccgcctgccagagctttgtcaatatgctgacagatatattgggcaaaggaacggaatatcagcatggtagctaaagtgacgataaaggccggcattttaacgtagcccaccaacaagccattgatcagaccgcagaccgcaccgaataaaagcgcaaacaccaatgtggccagaatactatccgtaatattaaacaggatcaccgacagcccgctgtttaaggccagcatggaacctacggacaaatcgatttcccctgtcatgcagaccaggcccattcccaggccgatgatccccaccactgccgaatgacggaaaatattcatggtcccgctccaggtcagcccgttgctggttaaagcatacaccgcaaaaatcagcacaaacacgataataaagctgaattccccgcaccatctggatacaacgcccagggacattccgcttttcttttctcctgccttcatctcttcatcctcctatttcctggttcacggcatttgtggaatacagcatgaccgttgtctcattgatttcctcgtgttccagaattttgatgatcctgccgttataaaaaactgcgcagcaatcagctaccttctggatctccggtatttccagggtattgatgagaatcgtctttccctcttttgccatttccagtatcagcctgtaaatctctgccttggcccccacatcgattccctgggtaggattatcaaacagcagaatatcagcatcagtattcagccacctggcaataaacaccttctgctggtttcccccgcttaaggatatgatagaattccggctgcttccggccttgatatttaacagggccttatacttttcaaaccgctcttcttccctctgttttcgtatgtgaggcctggccgctgacaaggtgtgttccgccagatacatgttttccagcaggttcatatcaggaatgacggaattttctttcctgttggaagccagcatggcaattttagacttcatggctttgtggatagaatgggaaggcacccgtttgcctctgatcctcatctcccctgatacagaccttgtgactccgaacatgcactgcatcaactcactgcttccggagccctggagtccggtcagcccgatgatctggccttttttgatctgcaaagacacctgttcaaatcctggccctgagaactcattaagctccagcaccacttctccagggtttcgcttctcatagacttccccggcagaataagtctctcctaccatcagtccggtcaccgcttccggagtcgtatcccctatggctccttctcctatgaactccccgtttcggaatacagtataccggtcagccagttcaaagatctcaggcatcttatgggaaataaaaataaaagaagttcccgcctttttcaagtgattgacaatggtgaacaaatgctttacttcttcattgtttaaagatgtggtaggttcgtctaaaatcagcagcttggcattgaagaacaaagccttcgcgatctccagcatttgtttctgactggtctttaaatcagccaccagttctccgggatttatgtcaactcccagttcatgaaacagctcttttgtttcctccatcatcttctgtttgttcagctttcccagcctgttcttgtactcttttccaagaaaaatattttcatatacttttaaatcattaaataaattcaattcctgatggacaaaggcaattcccagttcctccgactgtctgatggtgatggtatggatctcttttccgtcaaatgcaatggttccgctgtctttgggaaacacccctgtcagcacattcatcagggtggatttccctgccccgttttctcccaacagcgcatggacctcccctgttccacctttaagcggactccttttaatacctggattccgttaaatgttttacagatcccattcatttccaataagctcatatctcaacctccggttttataaaaggggccgttccttaagcgatgaacggccccttttgcccctcagaccattaattctaaaaggatgggtactcagttacattatctgatgttacgttttcacaggcgatcacgtgatcctgggtgacctgctttccgtccagataatctaccatgtcttcaatggctgtctggatcatggacgggctgtaagtaacggacatgatgccgccgcattttgaagcgatatcctgataggattttccccgaagcacttcatacagttcgtcaaggcctccgcagccggtaatgaccggtttgccggaaaggaaggtttccttggtagcctcatcaattccgcccccggaaagtgcctctaagattcccatagccagctcgtcatcctctgcatagaaccatttgatctcagcgtttttgctgtctcccaaaagagattcaaaggaggttttcgtgtctgaacggctccagttcatggcgccggaaaatgtaatggattttaaatcatcctgtgtccatttcttatcgtctgcaatggtctctccgccgaattccagttcccctgtcagatatttagtaaagccttcatctcttaaggtggtcacggaagaggtgtcgccttcatacacataaatggcttctcccggtgtaagtcccagggaaacgaaatatgccgctgcacctgctccaataccggaattgtcgccttttacattggatacagccttagcagccacgccgtcaatgatccggtcaaaggccacataagggattcctgcgtcaatcacgccctgaatggcggactgcaccgtatcgtcgatgggctggatgaccattgcaatatttttttctcccttggaaacgatatcctcaatgttgcggatctgttccgccgcattggcagaggtgatcagctcagctgtgtaggtgcctttcccatttacctcttcgattttctctttggcaaaagtagccaccgaaccggtccagccgtgatcctcaggaacggtaagaacataaatatgggcgccttccttaagagcttccgtttcttttgcagtctctgctgaagttgtctctgctgttgtctctacttttgccgctgccgttgtggtgtctgccggttttacctgggaacatgcagttcctgccaccgccaccaatgccgccaaaataaatgctgctgcttttttcatattactgattcctccttttacattttccttctctattaaagcaattttactacctcaacctaaatgataaactggtccatatatttcttagacagctttaagctgtccaggatcttttctcttgagccctcaaacgcctgatcttccacttcaatgcaggtaaacccgtcatacccgatatccgtcaatgcgctgacatattttccccagtccacatcgccaagaccaggaagcttgggtgacatataggccagaggatatgccatggtacctacttttttcagcttatcttcatacagtttaatgtccttataatgaacgtggaagattttcttctgaaactggtaaagaggctggatgtaatctatcatctgccagataaaatgagaggggtcataattaatcccaaggttttcatttggcaggatctcaaaaatcttttcccagatcgcaggcgttgtcatcagattctgcccgcctggccactgctctctgccaaacagcatggggcagttttcaatggcgattcttacccccttttcctctgcatgggcaaggatgggcggccataattctttcaccagatctaagttctcctccacggtctttgtctggtctctgccgataaaggtggtcacaagtccgactcccagcacagcgctggcatcaatgactttctttagatgggaaatattagcctgcctcttttcctcatccccttccattacattgggataaaaggcaagggcggaaatctctacattccgttctttgcagtagttccctatgtatgccgccttttcctctgtcagagaatccacgtcaatgtggctgacgcccgcatacctgcgttccgcctttcccctgggccagcaggccacttccacacactggaaccccatgtctgccgccgtatcgatcatttcctcaaagttccattcagccagaatcgcgctgacaaatcccagtttcattctatctctcccccttttccctgatcacaatccttcgtttctccctgctggactcctggcaggcaaacacggcttccatggcgtttagcacatcggccccgctgaccggcacttctgtccccgcttccagggcatccacaaatgcatcaatgattccggatttggtctgattgtcattggtctgcatcttatcgatgtcgaataaaatttgttccccattttttaaaacaacggaaatggaatggtcaggatcctcatagatcttcatgatccccttggttccgtaaagaaccgtggaattatcttccctgccgtaataggtccagctggcagtcatggttcctatggcgccatgctccatttcatagatgcagatggcgttgtcatctacgccgatcagctctcctgccccgtttctcttatccagtgtaagcatccgggctgtcacagccgctaccttctgccccagcaggaactggattaagtccgtcttatggactcctaaatcagccatggctcccatggctgccctctctttatcaaaaaaccagctgttggcgccgccgtctatgctccatgtttccggccctccgtgaccgaatgtggtcttaaatgtcaggacatttccgatcagcccctctgaaagaagctcctttgcccttgcatgtgccctggcaaacctttgattctgcccgatcatcagctgccggttgttctccgcagcagcgtgcaccattgccctgcactcctccaggcttactgccatgggcttttcacacagcacatgcttacctgaccgaagagctttgacggaaatctcagcatgagtgtgattggccgtgcaaacgctcaccgcatcaattccccggtccgccagcagggcatctgcggaatcatatacctttcctccatgaactgcagccagctcctttgccctctcctcattgaaatcataatagccaacgatctgggctccgggatgttccgcatattcagggatatgtctcgtctgtgcgatcctgccgcacccaatgattcctaccttcatagcttcctctcttttcctcttccgattggttttcatatggctttcatttctttcattttttcaaggtgattttaacattttcacagtcttttttcaagtttttgggcgttattaatagtttttccatgttatccccatattttattgtgataatataaacaatctgcacaatcatgcccctgcttttctgaaaagttttcaaagttatgaaaactttttatttacaacaggacttactcatgatataaacaaagtaaataacgtactgagggagaacggggaatgaaacaggagaaaattacaattgaagaaattgccagacaggcaggagtttcaccggccactgtctcccgcgtgttaaaccacagggagcaggtaaaggccgataccgccaaacgggtggaaagcgccatggccgcccttggttatgcatttgaatccacggctccgccgtccatcgaagaacagccgctgatcgttttgaatattccaggaattgaaaatgtgttctaccaggaggtcataaagggggcgagagtttcggcaaaagcccatggctgccacttgctcatcaatgaatcccctctggaccgaggctccatccgcaccttctgtaacctgctccaccgggtcaacgccgccggttctattcttttaaaccgggcatcggaagaacagctgaaacagatacgcgccatcacccctttggtgcagtgctgcgaatacaacgaggatgcctccggatatccctatgtcagcattgacgacttctctgcagcagaaactgccaccggatatttatgcaactgcggctgcaataagatcgccctgatcaacggacccttaagctttaaatatgcagtacaacggcaggaaggatatttaagtgccttaaaaaaggcggaaatttccgtgccgcaaaactggatcatacagcttcctgagatcaactaccagatggcctatgccgccatctgccgcctgctaaacagtgagccaaggcccaatgccttttttgtggcctccgacatttttgcagccgccgtcatcagggccgcaaaacggtttaagctcaatgtgcccagggatattatggtggttggctttgacaacatagagttttccacaatgacctgcccttccatcacaaccgtcaaccagccccgcttacagcttgggtatactgcctgtgaaatgctgctggaaatgatggaaaatccctccagctcccccaaatccctgatcctggatgcagagctggtgatcagggaatccacagcaaaaatctgatatggttttcacccaaaatgccaaaacagggccagcctttttataaaggctggccctgatatttttatgaatagaataaccggttgaccgcgctgaagatgccgcggatggatgctcttgtgatgttggaactgattcccacaccataagtagcctttcctgtcttcacatccaacaggtggatataggaagctgcctgtgctccggaaccggaagcaagagcatgctcgtagtaatccagaacccggatctcgatgccaagttctttttccaggcccttctgcaccgcatcgatgggtccgtttcctactccctcgaagatcttctctacgccgtgatccgtatagcggactttggcaagggttgagaattccacctcgtcctccgcctcagtaatctggcatttgcggaagtggatcggttctttcttctccgtgtagtggtttctgaactcatcaaggatctgttcgggagctacctcaccctgtctctcggaaatggcctgaatcacgtctgcaaactccttgtgcattccctttggaagcttgaaaccgtagaaggtatccatgacaaaggctacgccgcccttgccggactggctgttgatccgcacaataggctcatactgcctgccgatatctgacggatcgatgggcaggtaaggaacctcccaataggaattgttcctgtcccgcatggccttcatgcccttgttgatggcatcctgatgagaaccggaaaaagcggtaaaaacaagctttcctgcatatggatgtcttggctccacctccatcttggtgcagcgctcatatacgtcaacgatctcacggatattttcaatgtgaagctccggattgatcccctgagagaacatattgtatgccaccgttaaaatgtccacattaccggtccgctcaccgtttcctaacagtgtgccttccacccggtcggctcctgccagcagggcaagttctgtggccgcaatgccggttccccggtcattgtgggggtgaacacttaaaataatgctgtcccggttcttgaaatgggcattcatccattcaatctgatctgcataaacgttgggagtcgtcatctccacggttgaaggaagattaaagatgatctttttatccggtgatgcaccccaggtttcctgaacggctgtacaaacatccagagcaaaatccagctctgttcccgtaaagctttccggagaatattcaagggttacttctccgtcaaagccctgcatatactgcttcacccattccgtaccgtttacagcgatctccttgatctcgtctcttcccttattgaaaaccacatccctttgcagggtcgaagtagaattgtaaatatgcacaattgacttcttaactccctgaagggcttcaaaagtccttttgatcaaatgctccctgcactggaccagaacctggatgaccacgtcatcaggtatcagctttcgttccacaagctgccttaagaaatcatattcaatctgggatgctgccggaaaaccaacctcaatctccttaaagcccagtcttatgagcaggtcaaacatctcgatcttctcttccacgaccattggctctgtaagggcctggttcccatctcttaaatcaacgctgcaccagatcggcgctttcttaatctcattgcacggccattgtctctccggataactgactaccggtactcttttatatctttgataattcaacatgttttatctcctccatcatcatttaatcatctgtcctgtccggcggactgccgggattcattactgaaacaggacaaatatccttgttctgtctcataaaaaatcatcacaggctttggagtcggtaaatcacgctgtatttcttgacaatgaacaacgtggcttttataggtctaaccccatctttcatcattcctttgcattaaaatcacctaccatgctctgatagtgtgtcacggtgaagtgttatgttattatagcacgactaaaaaagacttacaacaggaaaattaactttctgctgcaagtctttataagcggtttatctgctcaactccagaagcttggattttaactcgccttccatccggcttaactctgcctctgcttcccggcgttttgtcctgccatctgcctggatccgtaccacttcatcaagggttgttatcagggattcatttgttttcttaagggtctccatgtccacgattccccgctctgattcctttgccgtctgaatggtggcggtctttaatacctccgcattcttctttaaaagctcgttggtcatatccgtcacttcccgctgggcctttgcagcctgttcggaatggttgatcccaatggcaagaaccatctggctcttccagagaggaatggtgttcaccagagtggactgtatcttttccgtcatcaaagtgtcattgttctggaccagacggatctggggagccatctgaatggatatcattcgggtcagctccagatcatgaagctttttttcaaaacggttcagcatggaagataagtcattggccgcctgggcgtcctccggaagcccgcttttggccgcccggtctaaaagtgccggaagctcttcctgctgcaccttggcaagttttctttttcccgccaggatatacatggtaagctctttaaaatacgtggtatttaaatcatacattttatccagaagggcaatgtcctttaacagctggatctgatgattctgaaggaccttgcagatctggtttacattggtctccgcctttgcatacctggcttttatgccctctaccctgtttacgctttttttgaaaaagccgaaaagcccttttcttcctcttccacctcaaagctcttaagctccacaaccacctctgacagcatctggcctacttcgcccagatcctttgactttacattatcaagggctgcttcggaaaaatcagcgatctttttctgtgcgcctgcaccatactgaagaatcagattggaatcctttagatcaatcttttccgaaaaatcggctacttgtctttcttcttccggtgttaagtccacaccaggcacttcttccaccgctttaagagcgctgggcctttgcaccagctggttttcttccgttccgctgacttcaagaggagccagcgtcagccccggcgcttcctttaacatctcttcaatatctttactcattcttcgttcctcctgtaaaatcgctttccgcccagccatctttttttaacatggtctggattacagacgcatctgtggcaacatccaaggcggcatcctggtaaagatcatcaagcagccgctcaaaggcctggtttatggtatcaagtgttctctctatctccgccttagcggaagaaatatttgcgccctgggatcccacgctgtcaaaatcacggtatgcatttaccagttttaccgttgtgggaaggtaatactccataaaacgttccatctcctgaatccgccttggatgcctggaaacggattcaaagatcctgcggatcacctgttccagattggaaattttctgagaaatcacctctcccggaatggcgtcattggcttcccttaatatccttaaataattctggccgtcggccatcatctgtttcatttcatcggaaggagtcccttcatttgccttttcactggcctccacaagctctctttccttaagggctttctgacattccagatactgtctgtaggtgttgtcacttaaaatcagacaggttttctgctcatctaaatacgcctgcttaaaaatgcccagcttgatcatcttttgaacgtcttttaatacgaaatcacgtgatcttccgatgcttcccgccagctcctcaatgctgcagtacatccgctttcctgactgctttgcatagatcctggctctctttagccggtccctgattgatatgcctgcacggagcatgaagccggaggcgcctcctaacaggagcaggaacagggtagaacctgccacagcccagatgaccggttttaccaccagcgccacgatccagacgatcaaaagaaacagcaatatcaggccaatgccaatgctgccaaacaccgtatacaaaatccctgccacacggcctgtctgatttaactgcaccagttctccctggtcatcaccgtttcttctccggacatcccggctggtctgaaacgctttgtatcccggcccgctttcccgttctccttcttgaaccggttcttccttccattgggttttccggtatcgttccgttcttacccttctttggctggaaaaaccttccggcggaggattcttaccaaaatccgccccctttaccagctggctcctggcttcctccagggcagaattaaccgtatctgatatggttctgttcagctggttaaaatccatggaatcaatggccttttgcaccgaatccctgatctggtctcctaaatttgaaaattctctattatccatattccctgatctcccaaaaacattttgctgcgtcagacttttatcatatcacgaaatgttctgatttacaattacgcatactttcaaaaaaatagaaagcagccaaaaccggaagcatcttccggcttttggatcactttctattctcttaacaatcttctaggaaagcagatggcctttctctttcattatctctatcacctggttcacatatttctcacaggtatggatatcagcagcttccaccatgacccgcacaacaggctcggtaccggactggcgaagcaggatccttccgctgtctcccaggctttctgcaaccttttccacttcagccttaaccgcctcatcctcctgggcagcagttttatcgtggacgcggacgttttttagcacctgaggaaaaatctcaagctcggaaaccagtttcccaaggctctccttcttttccagaatgacttccatcacctttaaggaggtcaggatgccgtctcccgtggtagcatgcttgctgaaaataatgtggccggactgttccccgcccaaacagtttccgtatgtcaccatgttttcatacacatatttatcgcctactgcagttttctcatattcaatgccttcccgctcaaatgccttgtataagccgaagttggacataatggtggtaaccaccttgttattcttaagagtgccctgctccttcatatacttaccgcaaatgtacatgatggcatctccatccaccaattctccgttttcatccactgcaatgcaccggtccgcatctccgtcataggcgaagccaacgtcagcccctacctcttttacaaacttcataagctgttcaatatgggtggaaccgcagttcgtattgatgtttaagccgtttggttcattgctgatcacatgagtctcagctcccagggcgtcaaacacgttcttggcaatagcagatgcactgccgtttgcgcagtctaaagccacctttttgttcttaaaggatctggttgctgtggaaatcaggtagccgatataccggtttcttcctgccgcaaagtccacagtacggccgatcttatcgcgctttgccaaaggcagctctcccatttccccatccagatacttttcaatttcaatgataacgctctcttccagcttttcgcccttttcgttgatcactttgatcccgttgtcataatagggattatggctggcggaaatcatgattccgcaggaaaatccttcggtgcgcaccacataggatacgcttggggtagtggtaacgtgaagtaagtatgcatcggctcctgatgcggtaagtcccgccaccagggaatattcaaacatgtagctgctgcgccttgtatcttttccaatgacgatcctgcacacttcctcagggttcttctgcccatagtaccagcccagaaaacgtcctaccttataggcatcctccactgtcagctccacatttgcttctccccggaatccgtccgttccaaaatattttcccattataatatctccttttcaccagtctgcaaatcatgtaaaataatataatttatcagaaatcgttttttagatttctgataaaaggcaacgctttatctgccgtccatccgatcatgaaaacatttttgttttcatgatataatttatcagaaatcgttttttagatttctgataaaaggcaatgctttatctgccgtccatccgattattgaaatatgaacttcattccaataatatgtaccatgttcatgatcttctgatttttctcttaaggcacttcacaggcgtatagaatggttcttgcatcattgaactcatagctgcaggtcacaaatgaccatagctgtttcaccggctcttccggcttttgtaaaaacaggccttcctttgtcatttcctccacatatgcctgaaagctctcctctgtttcaaatgcggttttccggcgaatggcagaggcatccgtataaagagcggtgacaggccgtaaatggtattctctctcaggcgtataaataaaaatatcctgatgttccttaaaaaaagcctcatctttatattttatgatatccttaaacatggtcccgtttttcatgtgatgcccgtatattatgttatgcctgccggaaaaatcaggttcactttcaaaatccaggtaaatggttcctgccacgcttttcttgccttcaaagtccgtatttaaataagtttcattgttatccgtatgcacaatggggtagtcaattgccgtgccctcaattttgatccagcccacaatatccggattgatctttttcagctcctcaaaatcaatgggaggaacataagcagcgcttgtttctgcttccggggcgctggcctctgtctcaggagccttggtctcccttgcaagctctgcaagactctcatactgctgcttggcatgatttctcttttgaaaatcagaatagagcattccaaggcccacagccagaaaaataaaggccaaaatgagaacgccaaaagccgattttttatttttcatgcttattcccgctttctttcctgttttaaacctttataagtatacattattttagtaaaaatctcaatcttttataagcagtgctagacttttccactttttttctatatacttataaaagaaaatgttattatggagacatttatgaaaaatcaagaaactatcattcatgttaatatgctggggggattttctgtatccatgggggacaggacaatcgtagaccagaataatcaggcaaaaaagccctggagccttttggaatatcttattacctttcggggccgggatattccggtagaagaacttattgatctgttttggaaagatgaaggcagcaataatccggcaggagccttaaaaaccttaatgttccgtgtccgcaagcttttggaaccattggaatatcccacacaggagctggtcttccagaaccgcaaggcttacggctggacaaaagatcttataacagtctgtgataccgaccgttttgaagacctgtgtattcaatcggaagccgccgacctttccggggatgcccgtttaaccctgtgccttgaggcctttgccctgtacaagggaaactttcttccaaagtctgagtgggaatcctgggtcgtgcccattcatacctattatcacactctctatcaaaaactgatccaaaaaactttgctccttctggaggaaagaaaagattatcctaccatcatcgatgtatgtcagcaggctattgccattgacccctacagcgaggatgctcattattacctgatctactccctgtaccagagcggaaaccagctcatggctatggagcattatcatcatgtgaccgacatgttctacaatgaatttgccatcacaccttctatccgctttaaagatttatacaagcttatcagcgacaaaaagcatgggatcaccatggatttaagcaccatacaggagatcctttcagaaggcggcatggacagcggcgctttttgctgcgaaccttccgtatttcgggatatctaccagctggagacaagggccatcgaacgtactggtgattccatcttcttatgccttctgaccatcagcaacttaaagggagagcttttaaagcctgcggtccagacacgggcaatggatgagcttggggaatccatccgcaaatcccttcgcaggggggatattttcagccggtacagcgtaagccaatacctcatgctcttacccacggcgacctatgaaaacggggaaatggttttaaagcgcattattcagaactttaagcgggaatattcaagaaaagacctttccattacgtattcactgcagagtatcattccacactgagctttatggaccagagatacatatagaaacaactgtttacaggaggtacagaatgctgacagatgactttatcacacttactttggagaagaaaaaaagcatcgcactgatcgctcatgacaacgaaaagcgcgcgctgatagaatggtgcctggagcacaaggccgctcttgaaaaacataccctctgcggtaccggaacaacagcccgcatgatcacggatcagacaggccttccggtaaaaggctataacagcggtcctttgggaggagaccagcaggtcggcgcaaagatcgtggaaggaaggattgatctggtgatcttcttctccgaccctcttaccgcacagcctcatgatccggatgtgaaagcgcttttacgtattgcccaggtttatgacatccccatcgctaacaacagggcaaccgctgatttcatcatcacctcaccccttatggatgagacttatgagcatcagatcgtcaacttccacaaaaatattgcggaccgggcgaaaaccctgtaaagggctttcatacggaataacaagaggcagggcttttccacatataagccctgcccctttttcttatgtttttatattctatccaaaaaccttttcacacaattttatgtattcctgataagccggaaactcctcaagacctgtgagacgtgctgcaacccccttataataccaggcgtgctccaacttgtctttttcgttaaaacgctgccaaagatcatctcccattaaaaaataatctcttgccgttgcccgcaaattgctcagcttgtccgccagaacaaggatcttgctttctctggaagcctgttccaagtgataaagagtagcgcatttacgttccttccagcactttgttttatcttccgtttcttccataaccagttcagccacccggggtccgaattcttccttaagctccgcttccgtaacgcccgaatcctccaccacatcatgaagaagggccgcgcagatcatctcttcatccgtaaccatcaaagcaacgataactgctgtctccaggggatggacgatataagggatcttcgtccctttccgaaaggtcccttcatgggacttggttgcaaatgcaacagctttctcgaccatactgaatctccttttgttctttttcaggcatatttttcctatatattatcacaaattattacgatttaacagagcttattttaaagccctttataaaactgtggttttctccttggaatcaaggttttaatgacttttagccttaccagctgctaccacttaaacgcaatctaaaaataatatgatctgctatgtaaaagcaggtattcgagattccggacacctgctttttgcttccactactccagataataccttttgactttccgaactaatgttcgcgcaattaaagcggaggtgatagcatgcagggaatatgccgccttgggcaagacattaatagctgtcctcactgtcaggcagatacaataggctgtgctgcccataatacagtatgttgctttcagtgatcctgaggcaagaaaagaagtaagaacagattgtgtaagagaaccgcgatggtatgagagatactatcagaagaggtagggtgtctatatccctacctccttttgcggccctgtgcagttattcctcccagatgatccacttgccttttgccatggcccgttgtcatttagatatcccagtctaacccggtcttccatgtgtatcttgccatatatccggcaccatcgaaccagtgccagccggatttcctttcttggctgatatacagtactggatcatatcagattaaattattaaaaagtttatactttgattacctccattttatattattttgctatcatacttgtaataatggaggctaacatatgaaaaccaaattaactaattcaatacttaggggacatgtaggctacggtgctggccctggcactaccgaaatccatgaatatgagtgcccttgcggaaaaggcagaatcttagaagaacacaataatattcctggtttcgaagaacatgttgttaatatccgttgtaatgaatgttgtaataagtatgaacttaacaccgagtttggtgtccgcagctggaaattagaggagaaaaaccgaaccttaggttgatttcagtttacctgatttatgacaaaaaacaactttatgtcagacataaactctctctccattattaaattggaagtttattattttgtcagcacttttatttgatatgtttttttcccacatttcggacatttcatatagcggtttcttcccatatgtggggcaaacacaacctgctttaaagtgggcacatatcgctcatggcaatgttgacattcataatatcctgtatcacgctccagttttacggaaaaatagatggctggtaggaagaggacaacagccaacccaattaaaatagcacgaatgacgggcgatacgttgccgaaacccgccatgaaaaccaaaaccaaaaacggtattgttcccatatacccaataacccattccagcttcaaaagatctctatttttggtctcctccatttctttgagagccagtaaatttgattctgcattttttctgtaatcttccataagatttaacttttccccgctgagcagctcgttaacacttattccaagaagctcacatagttctggcatcaatccggtatccggcatactttttccagtctcccattttgatatcgctctgtctgtaattcctaatttctcggcaagttgagcctgtgtcagatttttctcctttcggcaagaagcaataaattttccgattttaatctgatccatagggaaatcctcctttcttgcccttagactaccaaatcacaataagatattcaacgaaccagcggttgagttagccaaaacagctgcattctacctctgtttgagttccggatatcccattgattaaatgaaatttagtttatttggcttcctatatgtttatctaatctccattgcggcgcttttccatcatctccccagtattcatctattgccataattttctcctgttccattttaaaaaaagaaacaacatgaaaagacatttcatctgaccagacatgaacagctgtaataatcatgtttcctgcctgttcaattcgctcaacttcgccattccaatcccccggatactcgcagttggctcttaaaaactctgaaacattgaaatgttcgtttgtgcagtgccatcgaacataagcgtcttcatgaaagaatgtccttaatttttcaggattttgttcagcaatatacttccaatactcagtgatcagtctctgcacctccattatttttctccttaaattctttttaatacaatactacaataaagctcactaactatcaatattaagttttcagcgtattacttttctaccacaaactcttcactgatccatcaaattaccggcaggattcccgatcgtgccggacgctcctcccgcagatgatattctctccatacattgcggcaggcctaagtcagtgatttgtctgaggcagcagtggacattaaacaggccaaagacctattgggtcatatggatatcaaaaccacccttgacctccatatccattttggatttgatgatgttaaagcagacaatctggaaacctattattatgcagtcaaaatacattcaaaggaaaaagtgatgcccctgaaacacgcataaacacggcattttgtaagaataaattaaattattacgatttaacagataatcttgtaagatccctcattttctgatatgcttataggcgtaaaaaccatcagaggaaagggaatcagtatgaatcagtataacaatcaaatcagatcaaaccgcaggaacactcgctccggcagcaggcatgacgccggaagaaacggttttctaacggtccttctgttttatgtgcttcctttcatcgttgtcaatggcctgatcttctttttggtaacagccaaaccaaagggagaggttgccatcagtgaaagcagcgattatatttccacgatcatggagcttaaaatcaaatccctgcttccagtaaaaagcatggaagtggccatagacggtgctcccgttgaaataaagaaatcgggccttaaaacctataccgcagtccttacgagcaacggcgtacttgaggtaaagctgatatcctttaacaagatgaaaactgttttacatgagcaggtggatgtattagatgacacacccccggctgttaaggagaaggtctctgaggacggaattcttaccttccgtttggaggacagccagtcaggcgtggacttttcttccatttacggctctgatgaggaaaacccggaaatccttcctctgtccattgaccggagtacaggacgtgtgacctttgagcttaaaaaagacaatttaatcatcacggcaaaagacatgattggcaatgagatgcatgtaacctttgaccctcaaggggaaaacattgaagatgaggaaatacaagacggcggaactgaggctgataccgaatcttaagttcagccccatgacttatcaaacagtatgagatgcgtcaagagcctgccccttttggggcaggctctttttctttttcatttcggtgtaaatgtttttttatcttctgaatagtctcctcgcttataatatgctccatttggcaggactcctgatctattttaatttccagccaatggcctttttacggcagccaatgaacccggcataaatgccagcctggtttatcagcttttcatgtgtgccctgctgtacaatatgaccgtcagccagaaccagaatctgatcagcatttctcacagttttcaaacgatgtgcgatcataatgacagtcttatttttcgtcagttctgcaatggctcccatcagcaggctttcattttccggatcaacactggaagtggcctcatctaaaatgatgatgggagcatcctttaaaatggccctggcaatggagatcctctgcttttcaccgcctgaaagggttgcgccgccttcccctatcacggtattgtatccatccggcaagctcataatgaaatcatggcagcaggctcttttggcggcaagcaccacttccttatgagaagcgtccggcctgccgaatttaatgttattttcgatcgtatcggcaaacaaatagaccttttggaatacctgactgatattttccaacaggctgtccaaagtgtaatccttgacatcaataccgccgatggtgatttttccttcatccacatcccagaaccgggcaatcagattacaaagagtactctttcctccgccggatggacccacaatagcagtcgtggttttttcgggaatggacaggtttacatgttccaggatcttgtggtccccataagaaaaggacacgtcttcaaagagtatgtgaaaattctcaggcttctgtggtttcccccattcatccatgacgggagtcttgtctatttcctccgtcttatcaatggaaacatctaccagacgaagaagagaggaagtatttccggcggattgaagctgtccgaaaagcatgaacgaggcaactgccattaacaggcagaccggtaaactcatagaaccgtttaagtaaaatatcaatgcctcccccatgactgcaacactggttccataaagaatgacctgctgcagaaccgtatacggaacgaacaaatgctccagctttaagttcttgtttttgctttcctcaatggcctgcctcattctgctgttggagtcctttcccaggttaaaagacttcaccatcagcattccctgtacatactccagaacattggaaacaagggtttcctgtgcggcctgcctttccggaaatattttttctgactttctctgcaaactgctgatacaccaggtaaacagtatgatcccgcaaagaattgtcagtccgatccgccagtcgatgcagagcataacgaccgtgatgaccgccccgtgaatatacccgcctaaaatatttgtcaggaccatggaggcattgttttcaatatcgcccattgtggtggtaacgacagaagtgagattgccaagattgtggtcgttaaaataacccattggcatatatttgatacggccgccaatgtgaatgcgtttttccccgcacataaaatagctgattttcaccttataaaaatctgtaatgtagctgcaaaagattttcaggatcataccggcaaatacaattccaaatatctgccagatccctgccgtttcaaacccgttaatcatgccggaaaaaaccagtgcaagagctgcaaaagccatcatatcaaagatggagtgaagtaccgaaaacaagatagctgttttcatagttccctgcattttaccggagaacccatatatttttcttaatgtgcttatcattttctataccccctcacgcagcatccttagtatccatgtgggccttccacatcccctgatacaagggacaggaatgaagcagctcctcatgagtgccttccccttcaatttgtccgttcttcaccacaacgattttatccgcatcggtgatggtagaaagccggtgcgcgatcatcagaactgttttcccggcaatcacctttgccatggactcctggatcaatgcctcattctcggcatcaatataggcagtggcttcatccagaataacgataggggcatcctttaagacagccctagcaatggcaattctctgacgctcaccaccggataaatgccctccggcaccgcctgcaacggtctgaaatccgttttccaacttcagaataaaatcataacagccgcaatcccttgccgcctggtaaacctcttcatctgtcgaagaaggtctgcccaggcggatattctcaagaaccgtttcatcaaataagtagttatcctgcgaaatataagcgatctgatccatcaactgctccagagggattttccggatgtccatgccatcaatcgtaaccgatcctccggtcacatcccagaaaccggaaatcagctttgtaagggtggattttccgcctccgctgggtcctacaaatgccgtgacggttctttccggaatggacaagttcacctctttgatcagcggagttccttcttcataggaaaagcagacattttccattgagatattggacgaatggatcaaaacaggctgtgtgggccgttccagctctttttcatccagaacagagcagatttcgcctacaacggatttcatctgggctatgctgtcggtaaaattcattgcattgagaacaggggtaataatacccagggataaaacaatgcaggtgacaaaaaccgaaacgcttaaatctccattgcggtacagaatgcagccgacgggaagaacgctgatcaatacgctgggccatatggtaaacagcatggatttataaagctgaacgcttttcatccagttcactgcataagaggcatgatcctccactgcatccgaatatttctcataggaagctgcggactgatgaaaggctttgatgacctcgattcctccgatatattccaccactgtattggccattttccgggcacgcatcataagtcccggaatttttcttcatagccctttgccatcattttgtaacagaccatgcctgcgggcagtgtcaccagggaagcgagggccattctccagtcttggaacagtaaataaacaaaaatacatacaggaatacaaaggtttgccgtcaactccggaatcagatgagcaagggtggtttccatcccctccaccctgtcaaccaaaatgtttttcagctgcccggaaggagtgttgatcatatatcccatgggaaccctggtaagcttgtccgccagctgaaggcggatttgggccagggtttcaaaggtcgcggtatgggatacaaaggtggaaagattggaaaagcagacctttgccagaaaaccggcaccggcagccccgcaccactccatataggcagaaacggaagtttcacccttcatcaacagcaccacgatttttgaaacagcaaaaaacggtgcgagtcctgtaaaaacacccaggatcgctaaaatgactgaaagaacatatttattcttgcagggagctgcaagttccatcagcctggacattggattttgttttttatccattgtatattcgctccttttctataaaaaataaaggtcagttaactgtatctaaccaacctttattatagctgttccatgttttcctgccactctgatcaggctgccggtcccccgtttagacaagaaatttcattctactgaacaggctttacattgctcacatcaaagaactggggaacactggaaaaagtatatcctgcgattttggcagtgcggtacactaccagctcctttgaataggaaataggcagatcaatcacattgtcgttggaaatgttcagagccgtcctgattgcttcctgtactgcatccggttccgcggttgtggagaactgattgactgccgcggaatattcttcaaagctgtccaatgcctgcaaagaaacggcatgaggatccgcgccaagggattcctgaaggtatttgtgaggttccgtgtaggagccttccgtattccaggtggtaatatcatagtttccggcaacgccttctgtccaccatgtcatctgatcctggccggtagtttccacattaatgccgactttagccagctgagtctttatggccagagccatttcctgtgcaagggatagatctgtccaataggtatagcgaagtctcagggtttccccgtccttttccctgaagccggtactctcattcctcatccagcccgcttcatccagcaaggcattggccttttccaaatcagtttctcttgcaatgttatattcaatgtcagtataaggcgcgcctttgctgaataaagctgctgccggagtttcatagccataggtaagtccctgggtgatctcctgcttgttcaccccataggcgatcgcttcccggaccctcttatcgctgagcatggggccggaggcgttcagcaccagattccgggttaaggtactgccttcattgatctcaccggaaatcccatccagagtcattgcctgattataatcatcataagtaatcagatccgcaccatagattaagtccacttcgcctgtttgcagggcctggagacgggaagaggcctccgggatatatttgacaacaatctcatcataaaacggagcttctccccaataattctcattccttacaaaacgggtgcagtcgccggaaatcatctcagcccgcacataagggcctgtccccaccacatcctgaaaggtctggaagttgcctgcttcaaagaccttgggagacatcatgcctgcaacattctggaagcagaaatcgttgatgtaggaaaagcagggagcttcataatgaactgcaacggtatattcatcaactacttccacgctttgaatattatagatgcccttgatgccgctgaaattggtattagacttattgaattccagaatcgcctttacactttcagcatgaaaagcggttccatccgtaaaggcaacgcccctgcgcagcttaaaggtgaggaccgtgttggtctcatcccagctccattcctcagccagtccaggaacgatctctccgttctcatactctgccagggtttcatatacaagtccgcaggcgatgttattctccttgttcatggtcagagtagtcaggctgtccagttcttttgcagtgcagatcgtaagtatcttgctgccggattcagaacctttgtcaagagcattggcatgttggccgcagcccccaggcaaagtgccagaatagcgccgccaagagctgtttttaaaatttttttacaggtatttatcatgttatcctaatcctttctgctttgaaatatgtttaatcagatgaccctgttctacaatccttccctccccataatcacgattctgtcagaaatcctcatagcatctttccggctgtgagtaatgaaaatgcaggaacagaggtgcagctttgcagagttttccactaaggtaagcacggcatcggctgaaatcaggtcaagaccgcttgtcacctcgtccatgattaaataatcaggctcaacagcaatggcgcgaagcagtgacaggcggcgctgttctccccctgaaagccggcgcacaggagtgtgaagcagtttgtgatccatatgaaccgctgccatcagatcatagatccgctgcttccgctctttccggttatagtcagtcaaattaatcaacccctcctcaacattggaaaatgctgatcttgccggattcaaggtgccggaggaatcctggaatactgcctgtatctttttgcggtgccttttccattccccgtaattccaatttaaaatattttctccgtctatcaggatcctgccggcagatggcttttccaggcccaccagcagccttgccagggtgcttttaccggaaccgctttctccttctatagccagattttcaccttttttaagccgcaggtcaatatttgacagggcatggaagtctccctgggttttgctgtgataaatctggctgacattttgtattacgatttctcccatttccattccccctggctttcccttgaactcagactggaaaactccttcatccagcctgtctttggcactgataataattgctccattctgccctgttccattacttttccgcccccatcacatataccctgctgcaaagcctggaaagggcctccacatcatgggacacaagcaggatccccttatccttcatctgtactctcatcacctccagcagcagatccctgttttcttcatcaagagccccagtgggttcgtctgcgagaatatagtccggtgacattccaagcagaatggcggcggccactctttgaagcattcctcctgaaagctctgacggataggcgttcaaaacccgttctgtgtcttttaagttcaccaaggccagctttttccttgcaagatcagccgctgcccatctgttcatgtgcagccgtttctgaaaggtctcctgtatttgatatccgattttcagacggctgtcaaatgcggtcatgggggtctgtggtataaagccaatttttttcccccgcagatcacgatgctgtttacgggaaaggagggataaatccccatcatctaaaaggatctgcccgttgctgatctggcaatttccatgaagcatcccaaatacggtccgcagcaatgtggtctttcctgaaccgctatggcctgtcagcccggtaattgtggcggaaggtatttccatggacacctgatccagaagaaggcggcctgacttttcctttacacttaactggttgattttaagcatcatgtcacctccttttttgtcagccgtctgcctaaaatattaaagcagagggtcgacagaataaccacgcccatgggatacaaaatcatggccggacgaaggatcaacgcccctcttgcatccaggatcatgctgccccaatccacagcattgtcacccaagcctaatccgatgaaggagaatcccgtaattgccagaatcatatccgcacaagacagacacaggaaacgtaccatctctgaggccaggttagggaaaatatgaacagctaagattctgagcctggaagctccggaggcaacggcacacatgacataggcttttcccatttccatgtccgtacgggtgcggaccagctttatgtagcgcagcacgtaggagaccgttaaggcaaacagggtagttttggcgccgcttccccaggcccctataaaaacgatcaggtatgcaattggaggaatggctgtaaccccattgatcagcccgtcagttaaagcattttcccttatcaccgcccggctggttgccatacccatgacagtcccagccgcaaagacaatcacagagccgcctaatacaatgcccagcgtcgtccagcctccatataggatccgggagtaaatgcaccggcctaattgatcggttccaaagggatacccggcgcatggtgcctgaaatcttacaagaagattggattccatgggattatttggcgcaaggagaaagccggtgaaaaagaatgcgatcacaagcacaggtaaaataaaagagatgtactcagcagttttttttattcccatttaagccacctcccttttcccatgaatgaccaactggatcagatccgctgaaatattgcaaagagcaattgccatggccagaaataatacttctgcatggatcatgggcgtatcacggtccagcacgtggttcacaatcaaataaccaaagccaggaatcgaaaaaatttgttcaataatcgtcgcattagccagggccagcccaatgctttgaagaaaattaggaattaaaccaactgctgcacggggaaggaaatgaaaaaacagaagccggctttccgacaagccgcggcagcgggcataaaacccataatcctcattgctttcatgctctaacgcatccatgagcataggagtataaaaagacgctccaaatacgccaatacagattgcaggagatagatagctgagaaagcttgtgttgcccgccacagaaatcaatgatttttggactgcaaaataatccaggtaaacggttgccaaataaaaggacggaaccgatactcctaaaatacagatcacccttaaagcagtcttcggagccttccagggcagtaaaaaggcaatgcagcttacggctgcaatgagaataacctgaaatatggatgctaaaaaaacaatttccagtgttttgggaaaggccgttgcaatatccgtccatacatcatgaccgtttgccagagaagttcccaggtcaaaatgaagcaaattcattacccagcgcccatattgaaccaacaaaggcctatcaaaacctaacaggacccgtattgtctcaatttgttcctgagtgggacttcctatcattcgttttgcataagcagccgccggatccacaggggacagccgcatcagaagaaacgaaagcagcgtcacaaaaaacaaagtaaaaatcagctcaaatagttttcttagtatgtattttctcatatactgaccactcccgaattttagttaggtacagctaacttattatcaaaaagaaagagcgctgcgaggcgctctcctatcatctgcacacacagacgagagtatataatattctgggttttggtgctactctgaaaagaccaatcccctctatttggacaacttctttctgaattcagacggcagctctccaacttcctttttaaatacctcggaaaacttactgggattatcatagcccattttcatggaaatctctgtgatgctgtccgttgtttcccgaagcaaaatggtggctgcctgaatgcggtaggatttcatataagaataaatggaggagccgtatacgcctttaaagcacaccttcatcgaggtaagaggaatatcaaatttttttgatatttcctgcaaggtgtagtgcttttgcaagtcagcggtcatgtatgcctgtatctgcttcaccacctgcacctgattcctggaaaaataccgccgttcttccgggtactcgtcaacctggacgtcattaagaaacatgagtaattccaatactttcaccttcaaataatgagcgatcattttgggagtgaccctgtacagctctgaaaaaatatgatcaacattgctttgcccccggagaacatagcaggtatctttccggcaaaggcgcttctcgatctgacgcaggtcgatatgcagtccgcccagcacatgttcgacctgctccattgtaaccactgcctgattcaaatcaattgttatggaaataccatgatagtgggacaagggaaaggacgtagacacggtttcgtttgtcagccggttgatcgcaagatcccctgctcccacatattggcagtctccattactgaaaacacactcaaaccgtccttccctgcagtgattgatttcaagcacatccggatgtgggagcttgtttttattttgtccatccccatgtgaaaatcattataaaacaattcaataccgggcagtatttcgtatcgtgtaatcactccctctccggtttcgttttgcatcttatatatggaacagccgtcttcgcttgccgttttttgtacttccggatcaaagaaatccgtaatcttcttatgattcatcatgggatatcacctttgttctattttaattaggtatgactaaccaatgacagcatatcatttttcaggcttcccgtccattgcaacctaaaacttttcactgtcgggtataaaaagaataaaaataaagcccaatggaacagcattgccacgccgatcccattgggctattttttcaatcatatccttctggtagattctccctctaccagttccgccttaaataccattttctgatgactggccttatttttgatcacatcaaacaaaatcttaatggttgcccttgccatctcctctaccggctggcggatggttgtgatggaaggattataatagcgggcaatatcaagcccgtcatacccggccacacaatagtcctcagggatcctgcctccatgttcaaagatggccttgcaggcgccgatggcaatgctgtctgaaatggcgtacacagccgtaaattcccggttttctcttaaaacccggttcatcatccggtacccgttgtccatggtatagcattcctcgcattcatctgaaaaaaccatcaggggggggaaggggtgatgccgttgtctgcaagagcctttttatatccttccagacggaggcggccgatgctctcgtcgtcagaggcagcggtcaggatcaggatctttttatgacctagtttacataagtaatccgtcattttatagctttccccgtagtcatctacggatacgcaggaaaaatcaggagattcccctaagtactccgctattccgatggtacttaagacataaggaacggtcagctgttccagttcctctttgctgtgggaaaaatatcccccaaggaatacgatcccccttggctttttttccttgatcagctccaaagccacgtctacctcatcctcctgctcatccacacgctgcaggataaatgagtatttctttttctggatctcctcctcaaagacgcggatcatcttgctgaaaaagggattgccgattcctttgatcaacaccgcaatggctctggaatcggtacgctttagattccgggcactattgttgggaatatagttgttttccttaattacctgcatgatcatatcttttgtctccggattgatatccggatggttgttaatggcccgggacacggtgctgacacccaccccgcataatctggctatatccttaatgtttatggagcccatcagaaatactcatccctttcgtcatgccctgccgtaaagcctggctgtttttctgcatttttctaaaagctcttctgtaatttccccggaaaccatacgccatctccagttttttcccagggtggagggctcattgatcctggcctccacgccaagtcccagataatcctggaccggaatcacagccagtctggcaacgcttgccaatgcaaggcggataaaatcccagtggatctcttccctgggcgtctttccgttattcatgtagtcaatggaaaactgccggtccttaagtgataagtcttcataccaccctctgatggtattgttgtcatgggtccccgtatataccacgcagtttggcgtgtaattgtgaggcagataatcactttcctctctggaatcaaaggcgaattccagcaccttcattcctggaaatcccgtatcctttaccagctttaaaaccgacggagtcaaaaatccaagatcttctgctatgatatccagttttccgaacttttcccccattcgtctgaaaatatcgattccaggccctttttcccaaaccccatggatagcgttctcgcttcctgcaggaatggaataatactcatcaaagccgcggaaatgatccactctcaccacatcataaaggcggaagctgtattccatgcgcttcatccaccattcatacccggtttccccatggtatgcccaacggtaaaggggatttccccacagctgtcctgtggtggaaaatccgtccggcggacagccggccacggcaacaggctcacagttttcattaaactgaaacagctccggatggaaccaggaatccgcactgtcaaatgcaacatagattggaatatctccgatgatccggatcccctgctccctggcataggactttaaccggctccattgctcctcaaacttcatctgaaggaagccataaaatccgatctcatctgaaagccggctttcataccgggaaactgcctcagcccttctaaggcggatgtcctcatcccaatggatccagctcttccctttaaaatgatccttaaccgccatgtaaaagcagtacccggccgtttcctctccaagaagctttcccggctcctccggcttatgccctggtccttccaccgctcataagcctttctcaacaggggaaaacggttatcgtatatttttccgtaatcaatatccctgggatcatttccaaaatccattgcctcacattcttctgtagtgagcagtccctctttgaccagctcatccagatcaataaaataaggatttcccgcaaatgcggagaatgactggtaaggagaatccccatagccggtggggcctaagggaagtatctgccagtactgctgccctgctttttttaataaatcaataaattcatatgcctcttttgaaaatgccccgattccgtactttgacggaaggcttgcaaccggaagcaacataccacattcccgcataatcagtctcctttatctagtttccagggcgtgtttgaaaattcattgccatttttcaaacacaccctagccctttaccgcgcctgcggccacgccctttatgatgtatttctgacagctcaaataaaaaacaataataggaaagatggccagaaccagcattgccatcatggcccccatatcaatggagccgtatccgccctttaaattctgaataaccattggtattgtacctttttcctggggaagaatcaagcttggaagtaaataatcattccaaatccacatggcatttaagatggcaacggtcaccgccgtaggccttaacataggaaataccacatgaaaataagtctgaatgggagaacagccgtcaatcatcgccgcctcttcgatctcaagtggaatagcctttacaaaaccgcagaataaaaacaccgcctgaccggctccaaaacctaagtaaagaagcaccaggccgtatatggagtttaagtataagtcattggctgtctttgacatggtaaacatgaccatctgaaagggcacgatcattgcaaatacgaatacataatacaagataccggtaaatgcagatttcaccctgatcagataccaggccgtcatggatgtgaacaggatgatcactgccacggaagctaccgtaatgaacagggacctgccaaaggccgggaaaagccctgttttccggatgccttccacatagttggcaagccctacataagtgcctgcttttggaaactgaaacggcgcatcactgataaacagcttgctcttaaaggagttcatgaaaaccaggacaacgggaaataaaaacgccagggacaggaccgacaaagcagccgtaaggagcgttcccgtggtttttcctacctccatttgctggacttccgtattttttccctttctgctcatcagttctccacctccttacgccgtgttaatgaaagctgggtcagggaaatgaccgcaaccataagaaagaacaccgtagcctttgcctggcctaccccttcccagccaactctgccgtaaaaggtgttgtaaatatcaagggccagcatgctggtctgccttccaggtcctccagccgtcaatgccaggttctggtcaaacagcttaaaggaatttgtcagggtcagaaacaggcagatggtaaaggacggcatgaccattgggatcatgatacgctttaaaatctgggatctggtggctccgtcaattcttgcagcttcaatcagctctccgggaacattttgaagtcctgcaatgtagatgatcatcatatatccgatcagctgccagttcattaagatcaccagaccccaaaagccgtactcggcgctgaaggaaagtgtgactccaaacttggcaaggattccatttaacagaagctgccagatataaccaaggacaatgccgccgattaagtttggcataaaaaacacagtcctaaacaggttggtccccttgattcctcttgtgagcacataggccagcagaaatcccagggtattaatggtaacaacggacacaaccgtgaacttcacggtaaatatcagggcattgataaaattcctgtccaaaaatatttttttataatttgaaatccccacccaggacgcatcctttaccgtagtgaattctgtaaaggacaaataaatgcccatgacaaacgggtacagaaatgcaatggtaaacgcggccagtgtcggaagaacaaatattggaaagtaccgtttcattgacttttgcatagcagctctccttctataacgctttctctgttttggcaaaaacctcccataagccggagcccaaggtgttttccagggcgtgtttgaaaaatgggtgagacatctccctcgcgctcacccatttccccttaaacctattttgattctcttattttgtcatggctttttcgtttgcccaatcagccttcatctcatccacaacggccttccactccttgccgccctgagcgtactgaaggagggatgctccgaagttatccttaaaggtctggcttgggaaggacgtaaagttccaggatacggaatataagtccttgtcattcatataccggtcaatttcctttgccagaggatcggttggcttttcatctgctgcaaaggtgtcaaagggagcgataaagcccagcttgtttgttacataatcttttcctgtgtcagaagtaaagagccactccaggaagtcaagagatgccttctggtcctcttcctttgcctggctgttgatggagaagaaattctccgttccaatgcaaagtccctgcttttcctcgccgctgacgccggtataaataggaaggaatttcacatcctcttccttaacagtgtttccgtcaacgcctgacacctgtccccagccccagtttccgttctgaaccatggcaactttgccaagagcgaattctgccatggaatcctcaacggtttttgcacctaccatcttgggatctgtacaggagttgttgatgtataagtcaaaaacgttcttatagttgtcagcatacttaaagccaagggcatccttgtcggatacgttgtcatccttatattcataataaaccggaagatttgctaaatgggtctgccatctccagtcctccccgggagcaaaggaagtggaagcaaacacgccttcgattccaaggtcagcctttcttgcctgcatatcctctgcaactgccttaagcgcagcgaaattattcacctcatccatggattttgcctttgcaccgtcaagagcaaaatatttcttcataatggcgtcattatagatgatgccatagccttccactacataaggaataccgtaaacaccgtctccgtcctttacagccatatctttatcaaccagatgtccatagattgtcgtgtcctttaaatccttgcagtattttgcccaggccttatagccgatcggtccgttgatctggaacagtgtgggcggctcctttttagctacctctgattttaaggtctgctcataggtacctgctgccgctgtctgcaccttcatgggcacgccggtctcctccgtatactttcctgcaagctccacccatgtatcagccacttccggcttaaaattcaaataataaatctgtcccttggcttctgccgtatcaccggcttttgccgtggtggtttcctctgcctgggtattctgctccgcccctgtggtttccgcggccttgttagaagaacagcccgcaagtgttcctgctgccattgccgcagccatggtaagtactgccagtttcttaagtttcataatatcctccttccgtgcatacgcacattccggttgatggattttccacacaaccccaattttttcctccatgcctttcatacaggagcttgttttccccgcttgattccgggttttatctttcctggtcactggattatatcgtttcggtaaccataccggtaacgtttccaataaccttatggctataagatatcacaatgcacaaataaatgcaatagatttgattaaactttcatttttcgtcaatacatcaaattttcatttcgttttttgtgcattatgcataatatttttcgcctcatcaggcttttcccataacttttcaacctttcaatccagtttttcccaatgtcagattttcgtaaataaaacctaggaaatttgaccttgaatgttaagagaaaagaaatactaattcctgctttttcctgtagaatataaaatatgaaaaggaggaaatatttatgagaaaaatgaataaaccactggcggccattctcgttgccgcagccgtactttccatgaccgcatgtgcccagacagggacagcttcccttcccggggccaatgtgaccactgtcagcagcaaggacaccaataccatacaggtgtccagtacagaagggataaaagtggttcccgatatggcacaggtcaattttgcagtgctcactcaggcagaggacccgaaatcctgccaggagaaaaacagcgcagatacaaacaatgtgatatcctttttaaagaataccggcattgatgaaaaatctatccagacttccagctacggcctagagccaatgtatgactggaacaataccggccagcagatcaccggataccagatgcgcacaagcatcaccttatccgaccttcctttagaccaggtgggcggcctgctctcttccagcattgaggcaggcattaactccattgacagcgtaaactatctttccagcaaatacgatgaaacctacagggaagcccttaaaaaggccgtagaagcagccgaagtcaaggcagaggctattgcagcagccagcggcgttaccctggatggaatcgctcatattgaggaggtaaattcctaccccaatatcaggtactcctccaccgttgcaaaggaagatgcagctgcaggagccaaatccgtggttgtagaacctggccagatcggcgtagaagcccaggtgtcggtgacctatcgggtaaaataagtaacaaataaaataagtaacgtataaaaagtgagctttgaatggtcttaataaccatttcaaagctcactttttatgttgttcatatgttaaattacaaaggccgctgcagactcatcttcagcagccctgcccttggagcttttcttttatatcaggaaggacgctcctccacttgaacctccatccggctgcggggaatctcaattccagccgcttcaaattccagctttatcttttcaagaatttcccacctggccggccagtaatcatccaggaaagcccagcccctgcctccgatggtaacggcgttttccgttaagtcactgacaaaaacatctatgggctcctcttgaatgattcctctctggctatgaaaaatgccttccataatatcctttgccttctttaaatccgagtgatacccgatcccaaccagaacatccagccgtctcttatccatggcggtcacgtttgtcaggggggaattggaaagagtcccgttaggaatgacaacctgcttattgtcggcggtattcaaaaccgtgtacacaagcccgatggtgcggaccgtaccttctccatcctttgatacgatgtaatcccccacccggaagggcttcattagaaggatcagcaccccgcctgcaaaattggccaggcttccctggactgccaggcccacagcaatactggcagacccaagcaaggccacgatggaagctgaattcaccccgatctgacctgcaatagtaaaagccagcagacagtacatggctgcatttaaaacggacagaaggaattttcttaagctgacctccatatccacccttttaaaggaacggttcagcatacgattaatgatcttaataatcctggaacctatgaaaaaaatcaccagggcgatcaaaagctttatcccgaatgcgatcattccgggggcccagccctttaaggtttccaaaacggcattgggctttagctggtctaagttttcctgtacctcctgttggagatccgccagagactctcccggcagtacaccggaaaccatatgaaatatcatttaaaaacctcctgaccatatttcatttttaatactaatttttacctccggcctttgctttttcagtatatgcaggcttcttggcctttttcccagccaaagccggcttcttttcttcaggtgtacaggtaaagaccataacgcttaagggggccacggttatttctatggaatccggcctttcgtcggcctcttttttcttagaggttttcactctgggatttaccttgccctgccctccgaaggccttgtcatcactgtttaagatttccttatactttccttcaaagggtacccctaccgggtatctctcatgaagcacggtatcaaaattacagaggatgagaagggtttcttcctttttctttgtctttcttaaaaagcctgcaatgctgtcctttgaatccgtacactccacccactcaaaaccatccgggtcataatccatctgatacagggccggctggctcttataaagatggtttaaggcctttacatagtcttttgtcagcttatgaagaggagatgcaagaatctcccagtcaaggcctttattttcattccattcattgacctgggcaaaatcctgccccatgaacagaagctttttaccaggatgtcccatcataaagccataggctgtccttaaattcgccgcctttgcttccatagtatcccccggcattttacccaccatggaaccttttccatgaaccacctcgtcgtgggagaatacaaggatgaagtcctcactgtaagcataaagtatgctgaaggtcatctctccatagtggtgcttcctgaagtaaggatcccactgcatgtaaccggtaaagtcgttcatccagcccatgttccatttataatcaaagcccagcccttcatttttaacatcagccgtgatcctgggccatgccgtagattcttctgcgatcaggaccgctccatcttttcttcccttgaatatggaattcaaatgctttaaaaactcaacggcttccaggttctcatggccgccgtaaatattggggatccattctcccggattcttgccgtaatctaagtacagcatggaagccaccgcatccatgcggattccgtcggcatggtatttctccgcccaaaaaagggcattggcaatgagaaagttgctgactcccggcctgccgtaattgtagattaaggttccccagtgaggatgggccccctgccttgggtccttgtgctcataaacgcaggtgccgtcaaagctggccagcccaaagctgtccctgggaaaatgagccggaacccagtctaaaatcacgccaatatcctgcctgtgcatataatccatgaaatacataaaatcatcaggcgtcccgtaacggctggtaggcgcataatatccggtcacctgatacccccaggaagcgtccaggggatgctccataacaggaagcagctccacatgggtgtagcccatgtccttcacgtattccgccaacttttccgcgatctcacggtaattatagaattcagaaccagcaaccgggactccgttttcatcaagctttgcttccttccgaagccaggaacctaagtgaacctcataaatagacatgggtttttgcttggaatcagatacagccctctttttcatccattcccggtcctcccaggaatactggttaatatcccagataatggaagcggtttcagggcgcagctggcagtaattggcatagggatcgcttttgagctggggcttcccgttttgatgcttcagctcatacttataaatcattcctgtctttaagccgggaatgaacaattcaaaaataccggaatcccccagcctcctcatctggtgacgcctgccatcccacaggttaaaatcccctaccacgctgacacgcatggcacacggtgcccacacagaaaagtataccccttccgctccgcctgcagtcatggggtgcgcccccattttttcatagatgctatagtgaattccggattcaaactttttaatatcttctgacttgtagaaaggtccgtaggaatagggatccagacactcttctaatgtcccattgtcgtaagtgaccagcaaggtataagctgctgaagttttccgcggtatgagagccgcaaaaaaaccggcttcatccgcaagctccatgggatattcctttccgctttccttaaaacggacgatcactgattctgccgtaggaataaatgcctggataagcagaccctcttctgttaaatggggtcccagaatttcgtggggattggccgcttctgaatatacaatttcctcaatgccggcccaatccattaaatcatacaatttttcatccatacatagccctcctgatccctttttatagaaatattttatcactcaggcatgtaattttcaatactttaccaggaattgaaggtcatttggacctggcgtaagccagcatcaaatcaaccattcttccatagctgttgactccgtctgactgactgttcagctttaaatacgtatcattcatcttactggaaacctcggcagtctttccctcgtattttccccaaaattcattgttataccttaaatcttcccaggccttttcactgagctgcccgcagatttcccaataagtctcctggtctgtctttgccagggcattggtggcatagacccagccggtgagatatccgctgtagcggaatccatcatcatcagagccgatacatgccagatatcctatgaagttggcctcatcctccctcatgaatccccttagatgggaaagctcgtgacagacggtatggggaatgttgtaatccggcatggaccggttataagtggcctccaccgtaaaaggggaatactggccgcaaagctgctggactgaaaagaagtaagaccatacaagaggctttggcggcgggtaataacctgccagctccgggtaaacctcacccagccttttcatggcctttacgctttcccttcccaggctttttttatctgtttctcttgtgacgccttccccgcacatccggttaacgtcggcagtcagctggagacagagatttttcagctcctccagagaggattttcttacctctaaccctgaatagctggaaaagggcttcctgtaatagttgattccgcagttaagggtgaacagcaggaaaaggccggtaacaagaaacacggctcttatgaggatccgctttccctccctgcggtggataaagacataataaacggcgtacaggatgagtaagtaggtggcagcctccacaagggcaaaggggaacacccctgatatccttcccatgcttcccaccatgatacggtaaacctgcctggcataccagtccccgaatcccggaacctttcttgccagtatctgaagcagtattgaaactgcaaacattaacgcggacgctgcaataagcctcccatccctattccggcttctccccatgatccggttccccctggtgtaagttttttatatggattttataatatcatgattttgtggacaatccgtagagtatttgtgaatattttcttaccattttgtaaaaccccttgcgttataaatcaatctcatttaaactttgtaaaggaaccatcaggaaggaaaagaagtgaaatcatatgaagagagacgataacatgccaaatgaacgggaatcgttcagctggcgagaagaaatcatcagctggatcaagatcatcatcactgccgctgtcattgcatttttgcttaacaacttcatcattgcaaacagcagggtgcccagcggatccatggaacagaccattatgacaggggaccgggttatcggctccaggctgtcctattattttggagatccaaagcggggagatatagtcatcttccatttccccgatgatcccaccggaaagacctattacgtcaagcgtgtcatcggccttccaggcgatatcgtcgatatccgggacggaaaggtctacttaaataattccgaaacgcctcttgaagaatcctatctcccggagccaatggaaccggagcctgacgccagctacgaagtgccggaaaactgttacttcatgcttggggacaatcggaatttttccgcagacgcaagaagatggaagaataaatacgtagaaaaagacaagatcatcgcaaaagtcctgttccggtatttcccttccattaaaaaaattgaataagaaaaaacgcaggccaaaaatatttcctttgcctgcgtttttctatgtccttttaccactggtaatattttaccaaagcctgagttccctcatccccaaggccggaagcagccatggtctcatacatggaaagcacatgatcaagcacgccaaggctgatgccggcggcttctgcttcttcggcggcaagcttcatgtccttgataaaatgcttgatgaaaaatccgggagcaaaattcccggaaaggatcctgggagccattgcatttaactgggcgcttccagccgcgccggtggcaatggaatccaccataacccctacgtcaagcccgttggcctttgcataaaccattgcctcacatacaccggaaatggctcctgcaatggctatctggttgcacatcttggtatgctggccgttgcctgcctttccttcgtaccggatgacctttcccattgcctcaaagacgggaaggcaccggtcaaaggtctctctgccgcctcccaccagtatggtaagggttccttctcttgcccccgtatctcctcctgtcacaggggcatccagtgctgtcagccctgccttcctggcgtcctcatagatccgcaccgcaagcttggggctggtggttgtcatgtctatcaggcaggttcccttgtctgcgtttgcgatgattcccttttctccgaaatacacctcttccacatcctgtggatatccaacgatggtgatgaccgcatcccggcccttggagcaggccctgacatcctcgcaccatatggcaccttcagaaatgatatcctctgccttgctcctggttctggtgtagacagccacctcatagccggccttcatcaaattgcgtaccatggattttcccataatcccaattccgataaatccgattttcttcatctgtcttcccccttctgcaatttttagtttctcttttcgatgtccatgaccatatccaccctgcgctggtgtcttccgccttcgtatttggcatccagccactcttccgtgatcatctttgccatttccgaaccaatgacacgggcaccaaagcagagaacattggagtcattgtgcattctggaaagctttgccgtgtaaggctcgctgcaaacacaggcacggactccccggaccttattgcaggcaagagagatccccactcctgttccgcagatggcgattcccaaatcagcctctccgtccgcaacggcgcgccctaccttctccccgtactccggataatcacagctttccgtggaattggttccaaagtcgatcacctcatagcccttgctctctacaaatttcttgatgtcattcttcatttctatggccgtatggtcatttcccattgcaattttcatcgttattctcctgttattctgtcgttgccggctgaacatgcagatatgtcaaccgggctgttgtctgagtaaaatatatccggcatttaccttatcataaatgccggattttatcaagtttccaaacctccgtcaccttttccggcctcctgcctgccgtaaaaagccagtatcctgtccattctggaggccatgtttgcaaggagcaagtctgcagtggtaagagccgccatggcttccaccaccaccaccgcccgcggaacgacgatggggtcatggcgtcccttgatccggatctctgtttcctctccccggcgggtcacggtcttctggggctgggcaacagaaggcgttggtttaaatgcagcccggaggactacttcggaaccgtcgctgatccctccaaggatccctcccgcgtgattggttgccttttccactctcttattaaacccattgcaaaaaccatcgttgttctgggagccaagggcgcgggcggctgcaaaaccatctcctatctcaaagcccttgacagctccgatggacatgacagcctttgcaagagccgcatcatatttttcaaacacaggatccccgatcccggcaggaacgccgtcaatgacgcattccaccacaccgcctactgaatccagttttcccatcatctcttccaagtatgcctctgcaagagctgcggtttccctatccggcatgaaaaggcggtttttatcccgttcctccatattaaaatgctccggctttgcctcataaggtcccacagatctggtgtaagcgttcacagtgattcccaggctctttaaaaagcaggcggcaacagcgccggctgccacccttcctatggtctcccttccggaagaacggccgcctccccggtaatccctgatcccatatttttcatcaaaggtaaaatctgcatggccggggcggtaaacctccatcaagtttccgtaatccctggaacgctggtccgtgttccatatgaccatggaaatgggagtccctgttgtcattccttcaaaaaccccggacaggatctctgcctgatcggcctcctggcgctttgtggtaaatttgctctggcccggctttctgcggtccaaatactcctggatatccgcctcctccagtttaagtcccgccggacagccgtctaccacaaccccaatggcttttccgtgggattccccccaggttgttaccttccatattgtccccagtgttgatcctgccatgtatgtttcttcctttctttcctctcccttgcccgtgccttccgggcagagcccgtcccgctttatggggcgcaaagatatacctgcaaggtattttattttccgacttttacgattacgcagctgttaggctcgttgaccttgatttccttgccgttcatgatcaaaagtcccttctcatattcaaccgtgaaaaatgtaatgctgcctgtctcatggttgatggaagcgatatgcttatcatccgggaacacacagacatccttgggataactgccgcttatgggaagacagcatacgacctctaaaagcccggtgtccttgtcccgcatgtaaaccgaaacagaattgtctccggcattgccgcagaatacgtacttttcatcattggagaggcgcagggaacatgccgccgtaagctggctgtgcttggatcctacggtggaaatcgtctggatcttctcaatcttcggctggcgctcccctgtttcataggtgaacacatcgatcacgttctttaactcggaaataaggtagaaaaactttccgtcggaactgaaacggaagcacttgggagcggactccagttcgcagtgcagggcatccaccaggatcatttcctcgtcatgttcattaaaacggtagattttgatctggtcgattccaagatcagccaccatgataaattttccgtcaggagttctcctggaacagctcacatggggacggaagtttctctccgccacgctgccaagacccttgtggaacaccgcggtcacgatctctcctacagagccatccttatttaaacgcagcaccgtggattttccatcgtggtatcctgatacgaaaatatacttatcctccgcatcggtggacagatggcagcctctcatcccctttatattggctgaattaagccttgtgatggctccgttctcatgaatgcggaaggacacgactccttcatctgcgatggagtaaagcgtcttcccgtcattggatgcgatcacataagaagaattgtcaacctccacctcacatcttggaacaaaacggcccttttccacatcaacatcgtatacggtaatccccttagcctgtccgttgtaggaataagaacctacataagccatatacttgcctttcattatacatttcctcctgatatcttccttggcgtgattcccttcctgagggcaaacccgtgggcagcctgggttcagaaaatcagccgttcgacgagccgttaagcgaatcgaacttcctggtataacctaaaactatcatatcataaatttccccgtttgttaaggaaaaacttccttaaaaactattgacatacaatgaaaaaacagtataatgtatcttgctgcgtgtttatcattactaaactttttagttatatttatcgtcagttagtataggtaaactttcggcttattataacaaaaaggaggagcatatggatatcggtgcaaaactaaaagagcttcgggtcttaaaggggcttactcaggaagagctggctgaccgcgcagagctgtcaaaggggttcatctcccagctggaaagggacttgacctccccctccattgctacccttttggatattttgcaatgccttggaacctctgtcggcgagttctttaatgaaagcccggaggaacagatcgttttcggaaaatccgattactttgaaaaacacgattcagaacttaagaatgacatcaaatggatcattcccaatgcacagaaaaacatgatggagccgattcttctcaccctggaagccggcggagagacctatcctgataatcctcatgaaggtgaggaattcggctacgtgttacagggtaatatttccattcatataggtaacaaaacatataaagccagaaaaggggaatccttttactttgtatcagacaaaaaacattacttaagcagcaaggccggcgctactcttatctgggtcagctccccgccaagcttttgacaggaggataaagggtcatgggtcagccattaattgatttacggaatatcacaaaaagctttgacggtaccatggtactggatgatttaaacctctccgttaaggagaacgcatttgttaccctgctaggacccagcggctgcggcaaaaccacaacccttcggattatcggcggctttgaaagccctgaccaggggaaggtgatctttgagggacaggacatcaccaacctgcctcccaacaaacggcaattaaacacggtattccagaaatacgccctgtttaaccacatgtccatttcggaaaacatcgcctttggcctgaaaatcaaaaataaaccaaaagcctatatacaggataagatcaaatacgccttaaagctggttaacttagacggctttgaaaaccgcacggtaagctccttaagcggaggccagcagcagcggatcgccattgccagggcaatcgtaaacgaaccaagagttcttctccttgacgagcctttgggagcgctggacttaaagcttcgccaggatatgcagtatgagctgatccgtttgaaaaatgagctgggcatcacctttatctacgtgacccatgaccaggaagaagccctgaccatgtccgacactatcgtcgtcatgaaccagggttatatccagcagatggggtccccggaaaacatctacaatgaaccggaaaatgcctttgtggccgatttcatcggggaaagcaacattatgcccggaatcatggtcagggatgagctggtggagatctttaacgccaaatttgtctgcgttgacaaaggctttggaaccaacgctccggttgacgttgtcatccgcccggaggatattgatctggtatctcccgaggcaggctccctgacagggattgtgacccatctgattttcaagggcgtccactatgaaatggaagtgactacgcctaacggttttgaatggctggtacacagcacggatatgttcccggtcggacaggaagtgggcattcatgtggacccgttcgatatccagatcatgaacaaaccggcttctgaggatgaggaggctgtgggaatcaatgagtaaaaaattattatccggcccatatatcatgtggatgatcggctttatcctgatcccgctggcgctgattgtattttacgggcttacggaccggtccggggcctttaccctgggaaatgtcctttccgtcacaacggcggaacatgcaaaggccctttggctctcacttggactttcctttatcagcacggtcctctgcctgatcctcgcttatcctctggccatgatcctgcgctccaggggaatgggccagggaagctttatcgtttttatcttcatccttcccatgtggatgaattttcttctccggaccctggcatggcagaccttactggaaaaaaacggcgtcattaacggcattttaaacgcccttcacctgcctaaccagaatctgatcaatacaccgggagccattatcctcggcatggtttacaactttttgccgtttatggtccttcccatttacaatgtactgatgaaaattgacgacaacgtgataaacgctgccagggacttaggggccaacaccatccaggttctgttccgtatcctgtttccattaagcgttcccggcattgtgagcgggatcaccatggtgttcgtgccggctcttaccacctttgtcatctccaaccttttgggaggcagcaagatcctcctgatcggaaatgtcattgaacaggagtttaccaagggaagcaactggaatttaggctcaggcctttcccttgttctcatggttttcattctgatcagcatggcactgattgccaaatacgataaaaacggggagggaacggcattctgatgaacaggaaaagctttatcaaacgctttatccaggatttttacctggttatcattatggtatttttatatgcccccattgccaccatggcagtgctctcctttaacagttccaaatcccgtacccaatggggcagctttaccaccagatggtatggggagctgttctcaagcagcaccattatggcagccctttacaataccctgctgatcgcattcctttcctctttgattgcggtcatcatcggcactgcggcagccattgccattaacagcatgaaccggatccccaggtctgttctcatgggcattaccaacatccccatgctgaatgcggatattgttaccggaatctctctcatgctggcgtttatcgcctttcggttttccctgggatttcagaccattttgatttcacatataacctttaatattccttatgtcattttaagcgtcatgcccaagctaaagcaaacggataaaagtacttacgaagccgccatggacttgggagccacatcggtctccgcattttttaaagtggtgttcccggatatccttcccggcgtgctttccggttttctccttgctttcaccatgtccttggatgactttatcatcacccactttaccaggggagccggcatcaataccctttcaaccttaatttacagcgaagtgcgccggggatacgcccctccatgtacgccctgtcaaccatcatctttatcacggtgcttgtgctgcttctcatcaccaactttgcaccaaagcgtaaaaaacaataggagaacactcacatgaaaaaaaaattatctaaaatcatggcggtcagcgccctgtccctcctttccatctcccttttaagcggctgcggaaaatccgctccaaaggcaggaggcagcggagaggtttacgtgtacaactggggcgaatacattgacgagtccgttatcgagcagtttgaacaagaaaccggaatcaaggtcgtttacgacatgtttgaaaccaatgaagagatgtatcctgtcattgaggcggggggcgtaaaatatgacgccgtatgcccttccgattacatgatccagaaaatgattgaaaacaatcttctctctgaaatcaattttgacaatgttcctaatgtaaaggaaatcgatcccagataccaggaaatgtcaaagagctttgatccggaaaacaaatattccgtgccatattgctggggaaccgtagggatcctttataacaccagcatggtagaccctaaagacgctcccaccaaatggtctgacttatgggatgagaagtttaaggataatatcctcatgcaggacagcgtccgtgatgcctttatggtggcattaaaatcccttggctattcggccaacaccaccaacgaggctgagatcaatgaagcaaaagaactgcttatcaagcaaaaacctcttgttcaggcctatgtcattgatcaggtccgggataagatgatcggcggcgaggccgcagtgggcgtcatttactccggagaaatgctttacatccagaatgaagtaaaggaccttggccttgactattccctggaatacgtgatcccggaagaaggaaccaacctctggctggattcctgggtcattcctgccaatgcgcccaacaaggaaaatgcggaaaaatggatcaacttcctctgccgtcctgacattgctaaaaagaattttgaatacatcacctatccaactcccaacaaaggggcttttgatttacttgatccggagctgcagaataacaaggcagttttccctgacgaggataatttaaagaacagcgaagtgtaccagtatctgggagatgaggtggattctctttataatgaggcatggaaagaggtaaaatccaactaacagacagttaaaaggagaagatccggtgtgtgttcatataggcgcgcaaaacggatcatgggattccatgaagcagacagcagattatgctgtctgcttttataataacatgcttttataataacatgcttttacaagtgcaaatttttccattgaccacactggtcggttatgctacaatgcaattaatcgaccagtgtggtcaattttacactgaaaggatgtggttttgttgtacgaaaattttatcggcttaaaagaagaaaagcgggatgccatcatcaacgctgcctttacggagtttgcagaaaacggctatgatctggcatccaccaacaccattgtaaaggcggctgccatttcaaaaggagcactgttccactattttcccagtaaaaaggaactgttcctgttcctctgcagctatgcctttgagctggtcagccgagagttttaccagcagatcggccattgccagggcgatctcatcatccggtaccgccgggccgccatgctaaaggggcaggtataccagcgctatccccggctgttcgaattcatcaaacggctgacaaaagaaaaatcacctgatattgcctctgagctttcagaggagcttaagcgtgtgacggcatacggctatgagatgctgctgggtaatttagaccagtcccttttccgcccggatatcccctttgagaaggccagggacctgatcatatgggcgttggagaattacggtaaccgctccatggaactggtcggtgacaaacgggtggaggaaatcgacatggatgcccttaatgccgactttgatcaataccttgaggttctgcgtaaatgcttttataaacagtgaggaggaaaaaataatgtctgcaattgatattcatgatctaaggaaaagctttggaaaatccatggccttagacggggttgatctcctggtcccaaacggctcggtctacggttttatcgggccaaacggcgctggtaaatccaccaccatccgcattctgctggggcttcttaaaaaggacggcggagaggtaaagctgctgggcggcgatccctggaaggacacggttgagctgcacaagcgtctggcctatgttcccagcgatgtacagctttgggacaacatgaccggcggcgaaatcatcgactttctcggaaagctgcggggaaattattccagggaacgacgggcccggctgatccagcgctttgacctggaccccaccaagaaatgcaagacctactccaagggcaaccggcagaaggtaatgctgatctccgcctttgtttcggatgtggaactgctcatccttgacgaaccgaccaccggtcttgatccgctgatggaaaccgtgttccagcagtgcgtaaaagaggccagagaccaggggaagacggtatttctctccagccatatcttatctgaggtggaggcagtttgcgaccggatcggcgtcatccgcgggggaaggatcatccagcagggcaccatgtcggacttgaaagcgcttattgagggctgccagccgcccaccctggaaaccctgtttatgaactactacaaaaaggagacaaaagggagggtatgaagatgaagagatatttacacggcacggatgctctgatgaggctgtatctgcggcaaaaccgcattttcacgctggtctggctgctgctgccgggactttgggttgccatcaacaccatatcatcgctggtgctcttccccacacaggaggctcttgtcaggatgggtgtcaccctcatcgatccccttacccaggccatacacggcccgctgctggttgtttcggtggcaggttttgtcacctggcgcaccaaagtgttcatggtgatattaagcggaatcttcagcgccatccacatgatacgccatacccggctggccgaagagcagggaaaggaggaactgctgagagccaacgtgaccggctgcctggcgcccctgactgcggcactgctcacaatgatgctggtcaacggaggcgctgccctgctgacggctctggcaatgacggcgcttggtctttctctgaccggctccctggcccattgcctgggcttcttcgccgcagcctgcgtacttggcatcctgacaggcgttgcggctcaattctttgtgggagcttcggcggcacggggagctgcctttggcagcctgggaatactgtttgccctgcacaccctctggaatgcggcgggagcagctcatcctgcggggtatctcaacccccttgactggccgctgctgatccgcccatttgccggggagcgctttatggtgctgctgatccccctggcagcgggcgccgcactgacggcactgtccctatggctgatgttaaggcgggatgtgggcgccggattattcccccagcggaaaggacgtgcttttgcaaagcccggattccgttccctctttgcacttgcctggcgcacccagagaggcttgttcctctcatggtttttgttctatgccgtattttcctttgccttaggctgcgtcagctacttaatgacagacgccgtcagctcagcggaagcgcttgccgggctcattgaacgcctgggcgggatggaccgggcttttatgtccctgatgctgtatattttcagcatgatcatctccgtttatgtgctgctgtcggcagggcttttgcgtcgggaagaggtggacagaggggaaaccctgcttgccctgcccgtccgccgggaacggctggcattaagccatctggtctatatcttcggcggctcggcagccattgcactggtgtccggcttctgcgtgggcctgggaacggtagcaggaacaggagatcagggcgctcttgcccggctgttcttagatatggcagagaaaatccctggaatctgggtctttggcggcattgccctgctgttgttcggagctctgcccaaatggatgaacgggcttaactacggcctgctgatattgttcattctcatagaaattttgtgggaacagcagaatatcagcaatatgctgtatgggatttctcctttctcctggataacgccccttaaggccagccagccggctgcagcacccatcgtcctgtgcgccgtcacggcggttctgaccttggcggggattgcactgtttaagcgcagggatgcggcattgcactgaatacgaattactgacaggcgccggaagccagatccggcgctttttgctactgtttttaccgcctgggaacagctctgggaaaccggatatttcagcggcactttcagttccaaaaaatatatttttactgttgactggtgagccaaagtgcgatattttaaaattgaccaaacgacccttgtggatagcttcattaaggtctgcggcagagatttgatcaaatcccaggaggcaaagcctcctatgagatgatgaaggagcgtcaaatgaaaaccattgttacagaccgattgattataagaaaatttgaacaaagtgattggcaggatatgtatgaatatttgtcagacaaagaaaccgttgcatttgaaccatatgatatttattcagaagctcaggccaaagaagaagcagccagaaggtcagatgatgaatcgttttatgccgtctgcttaaaaggaagtgaaaagttaatagggaacctgtatctgggcaaagaggattataatacatgggaattaggatatgtgtttaacaggaaataccagggccggggttatgcaaccgagggagcaaaggctttgcttggccatgcctttacgcatttaggggcaagacgtatcatagccatgtgcaatccaaagaatgatcattcctggaagctgcttgagcggttacatatgaggcgggaaggcctgcttttgcaaaatatctattttaaaaccgacagcaatggtgatcctgtatggctggatactttcgaatacgctatattgagaccggaatggagtcaatggtatagggaagtcacccagtgacttcccttaaaaaatccgtgatcagtcttatcccaaacatatctatagtcaaagtccccgccaactacttcatgcttttctcatttcaagtgggagacttgcttgattcagttaaaagttggtgatcagaacttcaaccgtgaccgcattccgctctttaaactgatagctgcaattagaataagtattatcaatataatggactttataccccttgctccactcaatcaaaagatcattggacagtcccttatgatacaggacattggacaaggcaaaccgggtcccctgttcatgaagccggtccaaaagccccagaagggccttctcctctctttccttccagtccttgaatcctctgttcccatcgttgtaatttcctgtggaaatcaagtagggagggtcgcagtaaactaagtcatcctgccccaatcccgtaaaatccagttccataaagtccagattggaaaactcaatgttcttttcatgaagggcaaggcagaactccgttaaattcttctcaatgctgccgttaaaggagcttctgttccttccaaagggggagttgaactcatggctgttattaaagcgtatctgatggttaaaggcataacaggccagtacaaacagctccattagatcctttgtcttattataatccgaccgcaaggcataataaccttcctggttctgctgggtcagttcatactttaagatcagtccctggatcttctccaaaatttcccctatctccatggaacggaacatctggtacatctgggtcagataggtgatctggtcattgcagacgatctgctctgcattcacattgatccctacgttaaagcctcctgcaaatacatccacaaaggttcggatatcctggggaaacgccttaaaaataggctccaggatcttgaatttcccccctgtatagtttaaaggactctttatgtacatggcggcacctgcttttccatatagaaaagaagctcccgaagccgttccgtttccttcaccttccggcttttatatctgcggtacgggatctcatagatctggaaggtctctggttttccgtgctttttcatagcttcctcgatctcacttaccgtcataagcccgtccgtgctgtagcttaatatgatatgcttaaaccgggcattttcaagaagcttttcaaaggcaggaaccgctttattcttcatgcagaactctgatttctgtccctcatcgggcctctgtcccgtgactccccgaacctccggataatcatatctggcggcggtttcaagaacgtgataattggaaagatactgacgggcattatagggagggtcaatgtaaaggatgtccccttctatctgtgttaaaaggtccgctccgttttcattgaaacagcggttctgctttccgttatgggtcacaggcaggcggtacagctcataccgtttgtagctgcgcctttcccaggttttgtggaatgctccgtaagtccctgaggtgttggaaacaaaagggatcccctccacaatacaggcaaccaggtaataatactcgtcctcgcttaaaagcccggcagccttccagtcttccacagtgcatctggcatagtcaatgcgcagggcattttcatcgtttaaatacatgcggccgcccaggggagcataggtgttctggaaaaaacgccgctcccccggcagctcttctaaatcttttttttctctgccattaaaaaattccaccggatccctgatccctgtttcttcctgcaaacgggtaaactccggcatggcatcattctcaacggtagccctttgcagcacataggaaaagtacagcaggtcattggaacagaccttgtaccactgtttaaaatgtctggcaaccgcagcggttccagaaaatatatcacaaaagctttccgctcccggcgccttttcatcaatcacttgcctgatctggtccagcagcaatgtcttgctcccaataaatctcattcttttcttgctcccatttcattttagcctgcctaccattataatgtaaaatcacaaaaaatacaagaaaagttgagcttcctaaattccttcggcctcagaaccggcatttttccgtttccgccgtctttttaagcggtacatccgttcatccgctatgtttaaagcggcttccggtgacagtcccatctcctttgcaacataaaccactccgtagctgatggacattgggtagaccctgccgcctgctgccagcttcttatcaataaggcccatcttctcctccgccgcctgctccccgcagtcccggaacaaggccacaaattcatcgcctccgaaccggcaggtaaagtcagtatccccggcagattctttcagggcttttgaaacaaactttatatattcatctccgtacaaatggccgaaccggtcgttgatatttttcagcccatccatatcgatcatacaaagagaaaagggaatgcctttctggataaaggtgtcaatggtccgcagtccgctgcgccggttatccagtccggtcagctcgtctttataggccataacctctaaaaaggcttcattttccttctgatacgtgacatcagtcatgagatgaaccgctgcccgcttctctccccatagaagggaataggactttacctgaaaggtcttattgcgggagcatttgaattcataccgcagttcctgagaaaggccggtatgggactttaaacgggccattaaggggcagtctccttccccgcaggtatattgtcctgtacctggatcatagaaatgttttctggccgattcattggtatacaatatgtcccctgtctcttcttctatgacaacgacccattcttttaaactgtccatgatggatatcagcagagcattaaaccttttgttcttttccacctgttccttcagcctgttttcccttttctccagctggactaccatttcattaaacgcccgggaaaagtctcccataaagttcacccgctgcttataatctcccttgatcacctgatcggtctgccaggccagatgctttaaggcagcatgaagctgctttaattgccccgcctgaaaattataccgggaaggcatgggaacgtttaagtttccttccgccagatttttaagaaactcattggattccatgagacaatgagaaagaaaggaaacagtctggtccagatctgaaaacacctggtctctttcttccagctccccggtaaccggtctatttaaaatgatattgcggatctgctccagaagaacagaagcatctttctctgtcatccactacaccttcgcctgatcatcgatcctggcctcaaatctgcatacacgtgaaccgctggcccagcaatctacttcttttaccacatattcctttcccgtatattcctttaacactccggcaaggaatccttcgtcataattgcagacatggccgcctgttatggggagtccggaacaatccaagtcctccccaacggtcagaattacttctcctgtaccgggatcgaacttttcaattcttaaaatgcctattttatgtacctccaggctttgctgcagagaggcaataaaatcattgagcggaagggttatgtcaagcatgtgcaaggtaaattctcttcccgaaagctctccagcattccggaataagtctcttgtcatttcatcgccaaatctccggatcagctcactttttaaggaatactgaaacagccggtacatcatgacgggcatctcttcccccaggtttttcctcccttcagcgatattccctattgtgtcccaggtaaaatccgtctcttctcctgtatgaaaaatattgaacatatgcctcctcctgtatcttcatctgcacaaccagatccattcaatcaggatcagttacgtgtacattcataatttaagcatattttgcctgaatattaccaattttcagcctttttttcatttaactacccgattatgagggatacattttaagcaatatgggctatctgccaaatgattaaagtcaaccataatatattataataaagattccgacaaatttcaacataaaatggttacagaaattttctgttaccgttgaaaaaaagtcaccgaaataatataaggagaagccatcttgaaaattcataccgttccatggtaaaataagagaatatcctaatgaaagcaggaaagagggtgatgatacgaagatacaggaatctgccgaaaattatctggaaacaattctcatgcttaagaaccgcaacggctatgtgcgctccatagatattgcggaagaattggatttttccaaaccaagcgtcagcgtggcaatgaaaaatctcagggaaaacggatacatcggcatcgacgaaaacggtcacatctctttgcaggaaaaagggctggaaatcgcagaaaggatgtacgaacgccacaccttgctttcagagtggctgatggcccttggggtgacccctgaaactgcattggaggatgcctgccggatcgagcatgtaataagcgcagaaagctttgcagccattaaagctcatgtaaacgacagcaaagaatcataaaaacgaaaacagggaggcaggctgaccaatgaggacagcctgcctcctaacacatcatgggcccccggcgggcagcccttctttcaattactcagggatttgagccgtttccaaatccccgtcttccttcatccgcacccacacggccatctctcccggcgttcggttcgcccaggaataataaggaatccattttaatttctttttttcaaaggcaggagcttcatagggccggtataaggtttcttccccccagccggctgttcttattttttctccttcaccggtcagggtgaccactcccttaagcaggccgttttcaaattcttctgtaaatgccgtatcctcttttaaacagatctggtgcaggccgctgccattgtccgcctcttccagacagtagatgagggggcctctggaaagggctgtttttccaatgtcctctctcacctttggattggcctggttcatcaccgcctccattttaaacttacaaacgatctgatccccttttttccatttcctgaacatatatacataaccttttaccggatcgtttaagacttgttccccgtttatggaaatctcatattccctgcaccagtcaggaatccgcacagcataggaaaactctgcttcttcctgggtaaaatcaatttttactgttccatcccagggataatcagtctccacatgaaactccaccgtctgcctcttaaggacagtggaaatatctcctccgatgtataaattcataaagaggcagtcctctgcttccgtgtatgcatagcctccgatggaagacagcagcctggctaaattaggcggacagcaggcgcagccaaaccatttctggcgctctgctttcacatgccttttgttctggtccttttctgaggcttcaggcaccacttccagaggattgacatagaaaaacctggttccgtccagggacatgccgctgatggcgccgttgtataatgcccgttccataacattgatgtatttgctgtcctttgacaattcaaacatctttctggcaaagaagatcaggccgatggccgcgcaggtctcggcataaaccgtatcattgggaaggtcatagtcaaaagtaaaggcttctccgtaatgggaagagccaatggaccctgttatgtacatctgcctttgggtaatattgtcccaaagactttcacaggcttttttcaggctttcatcttctgtctctttcgccacagccgccatgccgctgtagagatagaccgcccggaccgcatggccttccgccttctcctgctgccttacctccttgcctgcctgataatactggtatccgaaacagctgtccttccaatagaactgattctggtttcttatggtctcctcttcaaaaaagagaggagctcttccccgttcatctataaaatattttgccagtgccaggtgcttttcctcttttgttacctcatacagccgtaccagagccatctcaatcacctcatggccaggatagccgtgtaatttgcctggccctgatccgaagatccggtcaacacggtcaacataacggacagcggcatccaagagcttccgttttccggtggcctggaagtatacgacggcagcttctatcatatgtcccagacaatataattcatgatgatcctttaaatttgtaaaacgtttctcaagcccggtaatgatgtaataggtatttaaatagccatcaggctgctgggcggcacagatatcgtcaatggcctcatccgccgtgctctccagctccttgtcaggatgccacataaggcagtatcccacggcttccagccacttataggcatcactgtcctgaaataccattcccatgaatttcccgggaatcttgccggaggccactttaaagttctgcatgcagccgcttggctccgcccctttgatccggtcatttaaagcctcccactggtacgggatcacatggttttgcaccaggtccagatattcactgaaaaatctgtccttaatcttaatctgtttcattgataatagtctcattctgacatactccatttcttataatccgtttcaattttcgcctttgtattctttcttagtccttcaagcctgacagcataacgccttttacaaaggcatcctgggtaaagaggaacacgatcagcacaggcaggaccgctatggtggaagatgccatgagaaccggccagtcggtggaatacattcctttcatgcttgccagtcccagaggcagtgtatatttcttcgcattattaatgtagatcaggggtgtaaaataatcattccaggtattcataaagcagaaaatcaccagggtggctatggtggactttgccattgggagcagtatctgtatgaatatctggaagggattgcagccatcgatcttagccgcttcatccagttccctgggcactgtaataaaaaactgcctcattaaaaaggttccaaaagccgataccatgggcgggatcatcagggaccataaagtattcaccagcccataggtggacatctgaaggaaattggttatgaccgtgacgtgaaaggggatcatcatggtccccagatacagcatgaaaattttatccctgcccttaaagttcagtcttgcaaacacatatccggcaagggctgaggtaaagacctggaaaaacaccacccagaccgataccttgatgctgttcataaagtagccaaagtaattaaagcgtgatgagatattggtatagttctgccacaccaggcgcttgcccaaaagcttgggaggaaaaacaaatacttcccccaaatccttaaaagaggatgacagcatccaaagaaagggaaccagcatcaaaaaggagcctgccagcaagacggcgtgtgaaatgattttcgttattttattttttgttttatcagacatgcttccctccttaatatatttccctcatgctcttttccatttttaagttaatagccgttatgatcatgacaatggcaaaaagcagataagcaatggcacaggcatatcccagcttaaaatactggaatgcattctgatacagataatggaccagtacggaggaggaccttcccggcccgccggaggtcatgagcatgacctggtcaaatacctggaacgaattgatgatggccataatgaatacgaaaaatgtggtgggtttcagcatggggatggtgatatatcggaaccgctgcagcttgctggctccgtcaagctccgccgcttcataataggtggcggatatcccctgcagcccggataaaaacaggatcatatcatagccaagccgcttccatattcccaccgctgcaatggatgccagggaggttgaagcactggtgagccatttcccctttggcagccccaaaagagacaggccgaaattgagaaggccgaattccgggttgtagatccactgccacacaatggatatgacaaccatggaagtgatggaaggcagaaaaaatgccgcccggtaaaaacgttttaatttgatctcctggtccagggccaccgccagaagcagggaaaggcacatcccaaccggcacggtcagggccgtatacagaatggtgttgcccgtaacctgccacacgatgggatcgtgtatcatttcagtgtaattccccaaccctataaatttaggctttgtcagcatgtcatatttggtaaagctcaatacaaaggttgcaacaaccggtaccagcatgaacataaaaaatcccaatatattgggcaggagcatgatccatgcccacttcccatcattcatgagcttgccgggggttttttgtgaacagcagctgctttcattgatccgcctccttcatggtttcaacggtaacgccaaagcagctaagtgccctggcgttatggaaccgattattccaatgcttctttaatcgcttcatttgatctcttttcgatgtttttcaatgtggtgtcaatatcctgggcgtcggtaaaatacagctttgtttcttccgttatgatatcgctgcatttggaggagtactgaagggccgcaggatccaccaccgcctccttaaaataatccagcatgttcttataatcatccccgtgaacatctttgttgtaccatttctccagcatgtcaggctcatacatggacttgcggtttggcatccaaagccctgaattaaccaaggagccctgataatcaaggccggaaaggaacttgacaaattcccatgcctgatccggatactttgtattggcggaaatgctgtgaagatgggcctggcctgtggtcaataccttcccataggatggaagaggcgccattccaatgttcataccagaagctgccagctcctgcaatgcccaggagccgtcgatcagcatggcgacttttccggtttccagcatctgtgcggcggtcattcccacgttttccagggtcgtggcatcgggagctgatccatccacccggatggccttaatggtctccagcacctttttcacctcaggggaattcatggcgctggtcttaaagtcagaggaatagatggcgccgttgttggaaatgatctgggcggcaagggtatttgccacggtttccagtccatagcagccatagatctcatccgttttcagcttcctggaaacctcccggaattcctcgatggtccagctttttgaaggatctgagctgggatactccaggcctgctttatcaaatacatctttgttataataaaggataggcgatacagtacaggaggatatcccatagactttcccgtcaatgctcatgatggttttggaagaatcgataaaatcatccaaaggaaaatccttgctgaatttgtcggttaattcaagaagcgcaccctttgatacgaactgcctgtatgcattggacatcatgaacatgacatcaggcatggaattggaggccgcggaagccaggagctttgcgttatactcattccccgcaagcccgggagtatagttgaccttaatattgggatgctctttttcaaaaatggcaatcccctgttcaacagcagctgtctccagagggcttgcttcccagcccatgaaattcaaggtgatgacttcttcctttccctctgtttttcctcccgctgctgtggatttatctgtggaagttccggaatccccgccggaaacctgaccgctgccgccacagccggcaattgatgccgttgtcataaagatggcggaacaaactgcaaatacttttcttaatttcatagtaacctcctcctgattatcccatttcccagattttaaaaccggactgctatcgatatttttgtaatatcttgtaaaaaaatgggactttaacacgacattattgacttattatagtcataatgctatatttaactaagttgtggcgtttaaattcaacaatatgtacatacgttatggctatatcataatatacatgatttcatcttacaactccccattctatataaaaggtggtcaaatcccagatgatctatttagtaagcaatgtgaaattttctatccactatttatccagcggaaatctgacaaataacttcaactttgtccatccggacagaaagctggattcccatgtactcatcattgtacggaaaggcaccctgcacatcacccagggaaatgcaaaccatgacatcggaccagaccagttcatcatcctctttgccggacagcgccatttcggctacaagcccagtgaagagccattgtcctattactggacccattttactatcccggatcctgattacaaatactacagcccttccagcttaaagaggaacttggaaatctggaacgccggtcctgtccagactccttttaccatgaccaattacatcctcccggaatacgggaccctgccaaacgacaaccggtcttctctcttttttgtccagcttcttgatactgcaaaaagggaaaattatgcggccacctaccgctgccattacattttaagcgctcttttgctggagctgggcacggaggcgctgttcatccctgatttgaccaggcataatattcccacctcaatggtcaatatcattgaatggatcaggctgaattacaaccagcccttaaccgtgcagagcttatcccagatgttcggctacaaccccacttacctttccggcttatttaaaaaatacaccggttaccccttaagcaattacatcaaccggacaaggatcgccgtttcaaaaaacctccttaccaacgacatcagcttaaaggtccggaccataggaaaattatgcgggtttcaggatgaaaaactgtttatgaaggtatttaaaaaaacagaagggatcaccccatcccaatacagggatgccttttcccggaaacacatgaacaaataagggagctgatcctgtttatggatggatgaaaaagcagcccggctgaaatagccgggctgcttcatgaattctttctcaatattacatccattctttataacggcgtttatacacctctttaagaaactgcacgcctgcaagataaccgatcaggatcagagccagccagggcacgaaccgtgccggtaagtagtgcatatcaaagccaacggaaagatcagtaaatccaatgaccagtgcaatgaccgcaacgataaatgtggacaaaaacaagggcattgaggacatgctttgtacaaagggcagcttttcggtacggatcagatgaatgaccagtacctgggataaggttccgaagacgaaccagccgcattgaaacaacggggacagctccactttgttggcgccgatggcccaccacatcactgcaaagcataaaatatcaaaaacagaacttaagggaccgaaaaaagccataaaggttttgatggactttgtttcccacttatgaggcttttttaagtattccttatccacatcatcaaagggaatgcctatctgggaaaaatcacacagcaggttctgggtcaatatctgtaccggcagcatgggcagaaacggaaggaatacactggaaacaatgacggaaatcatatttccgaaatttccgctcgccgccatcttaatgtatttaatgatatttccaaaggtgcggcgtccttctatgactccttcctctaaaaccattaaatccttttccagaagaatgatgtcagcagtttccttggcaatgtccacggcgctgtcaatggagatccccacatcagcctggtgcaggggcggagcatcgttgatgccgtctcccatgtagccaaccgtatggcctgcgctctgaaaggcttttaccacccgctccttctgggccggggataatttggcaaacagattgcagaccgaaaccgcctgtaacagctccttgtcatccatctgttccacatcccgtcccgtcagcaagccggaggcatctactcctaccttgctgcagacctttgccgccacaccctcgctgtctccggtgaggacgaccgttctcaccccatgttcccgaagggcggaaatggcagctcctgcgctctctttcggcggatccagaaagcctacaaaaccgattaacaccatatcccgctcatcatctacgctgaacactcccactccgggaacttcgttcttctgggcaaccgcaatcatgcgcaggccgtcggcattatacttttcataggttgccatggcaatgcgccggctctcttcatccatgggcagaacctttccgttcatttccacaaaggaggagatttccaggatctcttccactgccccctttgtaataagctggagctttccgtttttatcagtcaaaacaacgctcatcctgcgccgtgtgaaatcaaaggggatctcgtcaatccggctgtaggagcttaacacagattccagcccgttctgtccggcacggttgatgatggccagatcaatgaggtttttaaggccggtctgaaaataactgtttaagtaagcatggcgcaggatcctggcatcctcatccccatttaagtccatgtatctttcaagaaccaccttgtcttcggtcaaagtccctgtcttatcggtgcagagcacatccatttccccaaaggtctgtattgctccaagagtgcggacgatcaccttgtgttttgacatggaaacagctccctttgcaagggtggaggtcatgatcattggaagcatttccggagtaaggcctacggcaatgctgatggcaaatagaagcgctcccgcccagtctccttttgcaaagccgttgataaaaaataccacaggcaccataacaagcatcattctcacgagaagtccgctgacagaatccactccccgctcaaagctggttttggccctgtctcctgacagggattgggccatggagccgaaataggtgttgtttccggttgccaggaccactgccgtagcgcttccgcttaccacgttggaacccataaagccgatattttgtaaatccgttaaagcatcatcaggctgattgtccccatgggagaatttctccacaggggcggactcaccggttaaagccgcctgagccaaaaaggtatcttttgtggtcaggaagcacacatctgccggaagcatatgtcctgcggaaagcttgacaatatcccccggaaccacttcatccatgggaagctcagtcagttccccatctctccatacatccgccttgttggaaatcatctcggaaagcttttccgcagcagcgtttgaacgctggctctggacaaaggccaccatgcttgataccagcaccagaaaaatgatgatggaaacggtgagataatcaggtcttgaagaagagatgacatctgtgaaataattaacagcagcaatgatcagtaaaataatattaaacggattgatgaccgcctctctcagcctgtgaagagtggtatttttatttcctgccgtgatcacatttgccccgaattcttcctgtctttccagggcatccttaccggtaaggccgtcctttgatgcggacaaggaggataaaagcttttcttcttcaagaaacgcataggctctcagccttttttcggtatcaagtctgtttttttgaatctgcgtaccaattgttttgtttttcatgaatttcattggaatcattcctttcttttttaggattccccaatgaagatataaatagcaataaaaaaagccgtcccaatagacggcgttaagagcacaggctaagaaagcccatctgtataatcaaacaatggacaatcgcccgcttaaagcgccggtatattggtttatattttcatactggggtttgaagccgcatatgggacttcgagggctgccttccattgtttcacttcctttacattaatttaaaatcacacacccagtgtatccgatcgagatgaaaatgtcaaccttacttaaaaatatctgtgattgttcagttgttttaactggattttgcagcattttctggtaatatttggattatttgccgtatgggaaacgtcatataatgaatacatgataagcaaaggagtattgtaaaatgccgcgaagaggagaaaatatatacaaacgaaaagacgggcgatgggaaggaagaagcttaaaacaggatggaaaataccggtatttctattccagaacctataggggcgtaaaggaaaaaatgaaaaattaccaggaaatccaggaatccggcaaaaagaaaccttccggcagtgaaaaggacgcctgctgcctgtttgaaacctggctggaggatgccgcccttcgggtaaagccctccacttttgaaagctattaccggtgtataaataaatacgtaattccatttttcaggcaggataaggatcagaaaattacggaggaatctgttctttgctttgtaaaaaacatgagggagaatacagagctggctgattcctctaagaaaaagaatcttaccatctttaaaatcgcattaaaagagattttaaaaggctcaccggaaagcttttccatcatcgagcaggtcaaggtaccaagaccggaagacaaagaggtcaaggtcttttccttaaaggagcagaggctcatagagcatgcggtgctgaattccggggacaggcgtgcggcagggatcatcctgtgcttttatacgggaatcaggcttggagaattatgttccttaaaatggggggacattgatatggaaaccggcaccctgttcattgcccggaccgtatccagaataaaggattttgaagatgaggaaggcaaaacaaccctgttggttggtgctccaaaaagccggaagtctttaaggaaaatccctcttccggaattcctgttaaaaatgtcggaggaacggggatttttccgtgcaaatccggaccactatatcctttccggcgggacctccccctttgatccccgctgttttcaaaagctctataagaaaatattaaaggaagcccatgtccaggacaggaaattccatgccatccgccatacctttgccacccgtgccctggaaatgggagtggatataaagaccatcagtgaattgttgggccattccagcgtgtccatcacccttaatgtgtattctcactctcttatggagcaaaaaaaagctgccattgaaaaattcaatcatatgtatcactttaacatggaagcctctgccattcccagtcctgttacagggttaaagaaggttacatatttcctgtaagttaatccggcaggataatataaatgtggattccttttataattggttattccagaaaagcagtattgcatcttatactgcttttcattttcccctttttatagtcattggattatatcagattgaagcgcccataagcaaaagagaaaaggttttatttttttagtttgtttacttgacaatctatttttatgtatgctatgctaacaattgagttagggaaaactaaccagctcggtattttaagaaaggaggcctttggagtgatatacaacatggaaaacagtccaagccggtattataaaatcatacataattatcaggaggcacaactgctttttgcggccattcgcctgaatgttttttcccatttggacacgccgcaaacagcggaaacaattgcagcagcgttagactgcgataaaaagcagatccagctgctgctgctgtctctgacttcctgcggctggattagcaggcaaggagatttttacattaacacaccggaaacaaaagattttttatcccgaagcagcgaagtgttcttgggggatgctttgcttttccgtgagaacatgacttccctggcgcagttggagcaaaaggtgaaatccgcaaatgctctgcccaaaccggcttatgatttttctgagatggcgagggtgtctgtgcctgaaatgtatgccgggcgcctgcaatcgtttttaggccagatgatgaagctatatccagatccccaacgccctctgcacattttagatttaggcggcggaactggcatcttagccattgaatttacaaaacactttccaaacagcagggcaacaatttttgaaactcctgatgtggcagaggtcacaagggatattgtgctccgtcatcatggggagcagagggtagatgttatctccggggattttaatacggattctttgggcggcccttacgatgtgatcatcgcttccggcatcctgaactttgtaaggggtgatttatctgatttcatttgtaaattgtctgcagccttaaaggatggaggctacttattgatcgtcggtcagtatgcggaccatgaatacaatgctccgcccaatatgctcagttggctgtcgggtctgatggacggcgtgcccctccctcccagcagccaggagattgcaaaggcagcccaaaacgcagggcttacagccaccggctgcataggtgatgaccgatatgaagggcagttctaccgaaaggggagtttggtgtctgatacctgttcagacgatgtcattcgttcctttattgagctgaccgagcaaattgccaatagcagaaccaatattctggacttcggcagtgaggatatgaccttctaccgcggagaaatccatatcatcaaaatgattggcgattttccgggtatccacagcgctgagcttgcacgtaaatttggaatcacccggcctgttgttcataagactctgcaaaagctgaacgaacggggtttgattgccaaagaggatgacacagaggacagaaagcgcagtttgctccacctgacagaaaaggggcagttagcctaccgtaagcatgagaagtaccatgaggaaaacgacaaggcgctttttgatttccttgcggatatgcctggagataaattggaggcaattaatggatttctgaatcatgccattggtctgattcaaaaccatgcgtgaccgcatggggcacagcggagaccggaaagaggggtggggatgtggagcagaccgaatgggtatgctgtcccgtatgcggacaaaaaacaaggattcagattcgcagtgatacggtactcataaacttcccgctattctgcccgaaatgcaaacaggaacgtttaattaatgtgaaaaaccgaaaaatttttattgttcaaaggccagacgctaagacgcagtgctgataaaacatctcattgttttatcgactctgcgtctttttgtctgtatcaggaggagttcagactttgaatcaagaattgacatggcggatgattgcaggggttggcaggtacaacggccttttccgcgctcaacccgctgctctttgaaatacaaaatcatgcatataaggagaagctctacatgaaaaacaagtttattgccgctattctggcggccaacctttgcctgtcgttagcagcttgcggacagcccccttcgcaaggcggcgaatccaagatacctgaagcatctgccacaacccagatgtctgcaagcacagtcccggcggaatccaacgcaccccgaaggatcaccgacttaggcgggaatgaggtcacaatccctgcccccgcagaaattaagaaaattgtcatactaagcccgccggtcatgtcctttgtggtgagcgctattccggacacccagatgattgtgggcattaactcccgctcctttttgacttccaaccctaaagtcgtcgaaaaggtattcccaaactggaagtctgtagaatcgtcctttgtggatgtaaattttgccgtaaatacggagtcccttcttgcgcttgagccggatgtcatcttctattacggagatttccaaaaaaaaggcattgagggtcttaatattccggcagtggattttctgataaagggtgtcaacagccctgaaaaaatgtctgttgcctgggataagcaaatcagagaaattttaggtacagatacttcagtggggattcagaaggaatgggacaccaccaacgcaaagctggaaaacctgctgaaaaacgtgggcgttcagaaaaaaagagggctttgcatcaagctcaatcaggccggcagtattatggtcatgggctcggattcctttgacggctgggcgcagagcttttttgccctgagcggaatcgaaaatattgccgcatctgttgagggcaccggcgaggtcagcatggaacagatttatgagtggaacccggactttatcatgtgctttcaggatgttcctgcaagctatattctggagaattccattgaggggcaggactggtcgcttcttactgcgtggaagaataagcaagtgtttgatgtgccgagaacgacctacgcctgggtgactccttgtgcggattctcctctctttcctctttggctggtttccaaagcctatcctgagcttatgagcagaagcgagatcagggcagaaattaaggaatactaccgtcgtaattacggcgttggattaacggagcaggatcttgactcaatcctggactatcgggaagcgacagggatatgagaaaggagcataacacaaattacagtaaaaccatgatcatcggcgctttgctgttgacgggctcagtcatcagtgcaatattgctgggaaagtacagcatccgtctgcctgaccttatggctatcctatccgcaaagctgcacggaggcatggacagcacgctggagaccgccgcctttgtggtttttaacgtgcggattccgagaatcattttagctgcaatggtcggggccggattatccatatccggctccgccctgcaaggcacctttcaaaacccactggtaagccctgatttactgggggtcagttccggcgcaggctttggtgcggcgcttggaatcctgctcaccggcgggctgggcttgtttacaccggcactctcccttgccctgggactgaccagcgtgctcttggtgttttttctgtccgggtcaaggaacggcactggaacactgtccgtggttcttggcggcatcatcgtgtcctccattttctcggcattgatttccctgatcaagtatgtggctgattcttctgaaaccctccctgccatcaccttctggcagatgggcagctttgcaaatgcaacctaccgtgacatcggaatcgcttttgtccccattatgggagggatcacaggcttatatctgctgcgctggaaaatcaaccttctctctcttggcgacgaggactgttttacccttggaatcaatccgaacacaacccgctggctggtgattttattcgcaacggtgacaacggccggcagtgtgaccgtttccggtgtaattggctgggtcgggcttgttattccgcacatttgcagaaatctggtaggggtgaatcacgggcatctcctgcccgcttcctgcttaacaggagcaatctttatgattctggtggataccgccgcaagaaacttaacctctgcggaaattcccatcggaattctgaccgccctcatcggagcgcctttttttgcaatcatctataaccgcagcagaaaggaggggtgaaccagtggacaaattactggaagtacagggagggtgcttcgcctatacccagaatcagccgctcctgcaaaatatcaccttctccttagaaggcgggcaggtgatggccgtcatgggccggaacggcattggcaaaacaacgctgctaaagtgcattgttggcatcttgagctggaacagcggctattccgcaataagcggtaagaggagccggaaaaacaaaccaatgaaggaaatcggctatgtgccgcaggcccacaaggtttccttcaactactctgtaagagacatggtggtttttggaaagacagggcacagttccttctttgccgcgccgggcaaaaacgactatgccttagcggatcagatgctggaaagggtagggatccatgatctgcgaaaccatccctgcagcgagctgagcggcgggcagcttcaactggtgttcatcgcccgcgcccttatcaactctcctcagcttttagtgctggatgagccggaatcacatttggatttccgcaatcagatccgtctgctcaaacttattcaggcagtggcatccgaaaagaacattgcctgcatcattaatacccactacccaaatcatgcgctccgcattgcggacaaatgctttttgctgggcgaggaggattatatcaccggcaatacagagcaggtgatgacaggcgcaaacattcagaagttttttggtgtatattctcactctgttgagttttcatataagggaaagaaggtcacctgtttctcattcctggatgaggtataaagcagcatgatacaatcccagcccagcgaaagcggggtataaaggccttactcttcggagatcctggcagttaccatggcgtggagcttttccatggtcttccagttccgcactgttacaggcccgcccaatagggacattttatctgaaagcttggaattgcggatgctgtggcaaaggagaagataaatctccctgccctgcatccggtaatcatccttctcatttacaaaagggtccaggcgctttgtctcttctttaagaggcgcctgatggaaaaggcagacataaaagctttctccttctgagttttgggccttcgccgcctccctttccttttccgtataaggacagctcctgatcagctgacccagctggtcagacgttctcaaaattacgcttacggaaaaaccaaatctctccctgatttgatcctccagctttttcttcagctcatcttccccatcttctgactcaaaaatgacattgccgctctggatataagtctccacccgtatcagcccggcctcttcaagcacctgccttaattcagccatttttatcttgttttttccgcccacattgattccccggagcagagctatataaatggtcatcttccagtcttctcctttcacagccttaatttctacatgatgacattggcctgattccgcccttccgacttagacttataaagggcctcatctgcccgccttaatgccgcctgatagtcttcatccccttccttaaagaaggaaaaccctgcagatacggtgatgccgatctcttcatcgtgatcctgtattttcaaagaagatatggaggccaaaaatttgtttccaaaagccagtgcatgtttcttctccatgccgtaaagaatgacaacgaattcatctccgccccagcggatgatcttgtccgtatttcttaaagtttttttcatcatctttacgaactctgccagagccatgtcccctgcgtaatggccgtatttatcattgatccccttaaagtggtccatatcgcacatcataattccggggcttaagcctgtccgcttaaattccttaaaggcattggccaggtcatttgttccgcttctcctgttgcctgcttttgtaaggacatcctggttaagctcagattccatcacctttctcgcatggcggtaatagaatttctccaataaagaaacagagaacaggctgatgaccagtatgatgataagaagcagcaccaaaagcatggtgagcctggataccagcaccttgctttctccattggtctggtcaatgtaaggctgcagatcatccagataaacgcccatggcaattacccagtcataatccttataaagcttggcataagtcagctttttggatacgtcattgtcatccagctctttgaaataataagagaaaaacagctctccatcctttttaatcccctgaagctcggtcaaatacggataattcccctccatgtctgtcatatccgtagaaagataggtcccctctgtctccggcaggttgggatggatccttcggatagcgtaatttttacccccctcataattcagtatctcgtttacccagatataggaatttccatcaaatcttgagtttttgatcacattgaccatatctgctttcacaaggccatccacatagctctttgtcagtccaaaaaggaaggagtaatccccgtgaatgaaaaccctgtaagaggataaacctgaggtgttggccttaagagtatccttccagacagactttgccaggttccccggatcaaaaaccggcttatttgcctcattgtcccacacaatcacagtcatataattataatccggattgtcccggaagaactggatgaagaaatcattgaattcccggtctgaaagatcctttttcatgttaatgatctcagctgttctggaaacaaaggtttccacataggaagctttggctgcccgcctcagctctatttcggaaatcaggttattgaccgtgtcctttagaaaatcctttttaatgttatagattgcttcctctgatttctcaacataaatatcgcccactttgtcaatggaaaataaataaaagcaggccatgacagtacagatgatgctgatgattgtggatagaaatattgtgtatttacgccggataacgcattcctccctttttggaatgtatttttttaccatagtacctaagcgttttcatctactcatccacatactccagaaaaatcctgtctttaaagccgcccctgttttttgccttcttttcccgctctgcttccagttctgctgcggtataacccctggcactgcaaatggaatacaacacttccagtacatctgccatctcttccaggctcttgtcctcctggtattcctctacctcctcataaagcttttcttccagtttctctaaatgttcttcctcagtcaggatgcgccataccacctttttcccttgtgcctggatcacctccggtattctgtccctgactaatttatcgtaccttttcaatggcaaatcccctctttccagttgattatataacgacagcctgtactttgcgaaagatacacttttaagacagtatatcacattcagggaaaaatgtcgctttttcctgttaataattgcagcttaatgtttttgctgttttcccttcattttaagaatttaaaaagcccccagaccaggggaggctgttccctttgtctgcggggcggctgtcttataacgaatttaatattccaccttccacatatacctccttgtggaaaggggatgctgtctcctgcctgccagggcatgattgtaaacatcatatacattattaaataaggagtggttaaagtaggagacaacagaagagtcaatagtggacagacctaagtcttttgcgtccagcacttcgatcctgcccgcatattttctcaaaaaggacaaagccctctcgtccagttctctggcaggcccttcgctgatctggatcatgaacggggattcggcatcggtaatttcaaagggaccgtggaaaaattctccggcatggatgctggaagaattgatccactgcatttccatgaatatgcagatgctttccatataggctgccccataagcggcgccgcttcccatggtataaatcaccttgtcatccttgtattcctctgcaaaggccacggcccttttttccacatgtttgcgggcatattttacgattccgtcaatacgggatactccatcctggaatttgtcgtaatgttcatagccctctgtctggtccagcagctccaccgcagccatcagcccgaccatggtcttttctcctccaatatccttttcctcaccaaaggtataggaaaccacataatccgatgcctttgtgattggggaatcagaagaccaggtaagggctatgaccgtggctcctgccttttttgcagcctgggcggcttttacggtttccggggtgtctcccctgtgggatgctgtgatgacgactgagttttttcctaaaatcctgggcgtgttatgtacgaattcattgctgttataccagcccgtccgtatggacaaagcttctgtttccagaaaaattttagctgggtaaaaggctcccagggagccgccgcagccgacaaaatatacttcccggactcctcccgcttctttcttcttttccacgatttcagttatgatttccttgactgtcataatgttctcctccgctttttaattaatatcttatatgacgtattataacattatgtttatatttttcaagtacatccttgaatttatttcatatattcgttgactcttgttatatgatgttatataatgtatttataaatcaagcaaatttatttttggaggtacatattatgacagttaaagaaattgtttctgcaatcaaggctgagcatccaaacatcacttctgtctgcttcgtgggttgtggtgcttccatgtcagaattatttcccggcaaatatttcctggaagcaaattccaggaggcttcgggtgagcatttacactgccaatgaatttaactattccaccccggtatccgtagacgaatccgcaatcgtggtgacctgctccttaagcggaaacacccctgaaacagtagccgcctcaaaaaaagccatggaccttggcgctgccgtcatctctgtgactcatatagaaggctctccccttgccctggcgtcccattaccagatcattcatggttttgaagccagctacgcggcaaagatggagaaaatgaccgatgttcttatgctttccgcggaaatcctgaacacctatgaaggatatgaccattacaatgcaatggaggatggattttcaaagatttacggcctgatcgaaaccgccgctgccatgagccttccggccgcaaaagcctttgctgaaaactacaaagacatgcctattttatatgtcatgagctcaggagcaacacagatggtttcttattccttctcaagctttctcatgatggaaatgcagtggatcccttcaagcaccttccatgacggcgaattcttccacgggccctttgaaatggttgaaacgggggttccctatctcctcctgatgaatgacgggccgacacgccccatggattccagagccctcacctttcttcagcggtttgatgcaaaggtaacggtcctggatgcaaaggatttcggcctcagctcccacattgataaatccgttgcagaatattttaaccccatgctgatcagcggcgtcttaaggatctatgcggaacagctggcggccattcgcagccatccccttaccaaaaggcggtatatgtggaagcttgattattaagcactttcagtccccattgcagattttaactgatattccataaataaaaatgtccctgtatgacagtccttaaaaaaaccggatgtcttacagggctttttatatgctgcggatcactcttcaaacttttttccatagccaaaggaaccatccttctggcagttctgggaagaataaacagcggccttataaaggctggtctttatgaccaggtccttgaattcctgccctgaggtaattccccacattcctgaaccgtcaggaaaatccaccgcatatttcattccgtccaaataactgaccagaaaacaggtgataaaggaatcccctgctcccatggtgtccttggcctttaccagacagggtgactgttggtatatgtttccatccacatacacaaatgctccctttgcccctctggtggcgatgaccatgctgcggcagccataggaaatgatggagcttatctgatcccggatctcctcctccgccatgtcttctccgcaggagatgcaggcgcagtcaatataagggcaggtctcctttaagtactccaaagaggcgcggttggaaaaatccatggaaagaaaggccgccgctttcttaagagccgggagctgggcctccatatagctgaaaatgctggtatgcaccatgtcataccctgctatatattccatgtccagcctggtcagctccagaggatggtccagggaaactccgcctttattgcttcctatgaatacccggtccccgtcctccagcttcaccttagccgcaccgttttcccctttccagaagcggcatctggaaacgtcaagtcccagggccgaaatcgtatcatatacgtgccgggcttccccgtcatctccgaaattccccatatatccggcttcatagccaaagagctttgcatacaccgcaaaattcaaggcattccctcccgggtacatggtcatgatgtgcatgtacttatccaccacattatctcccaagcctaacactctgatcatggtttgttctccttttaccgtcataatcctatatttttacaggaaagccccgcctacgcttaaaccttgtgacctccctgatgcccgcttcttttaaaagctgttccgccacatgaaaatccgccgccacatcctccggcttatgggcatccgatccgaccgttaccacagttccccccagctggacaaacagctttaccgttcttaaggatggaatggtctctcctgccccctgtctgatcccggaggtgttgatttctattcccttgccccttgccaccaggtttttaaggatccgtgtaatttctttctcatacctgtcataataatctggaaggccatttcttacggaatgccttttaatcagatccaaatgccccaggcaatcaaattcccccacctccgaaagccttaataaatgacggtaatatgcctctgcaatccggggcatggttttttccgtatattccatctggctgacatccacattttcaatcttgtgaagagagccgataataaagtcaaaggggtattcaaagatgactttcaaagcatcttccggacataagtgcatctgccccatctccagcccccggcgtatcaccagcttcccttcgaatttttccctgcacttttccaggcacttccagtactgttttaagtaatcctcatgaaaatactccttcaccagcccatgggcataaaattcataatgatccgtaaaggcgatctcttccagccccttttttatggcgctttcgcacatttcctccatgggggcccctgcatcgggagaaatgctgtgaacatgataatccgctgtcagcatggtcatccctttaccgccccctgggtgagtccccggacaaactgcctctgcatgcacaggaacaaaagcaccatgggaagggaggcaatgaagatccctgccagcatgaccacgtaatcggactttaaatctccctggaacgccataagccccagaggaatggtcatgatggccttgctttccagaaatacattggcaaagaggaattcattccacacaaagtttaaattcacaatggcacaggaagccaggaccggcctgctgatgggaacgatgatcaggaaaaaccgctgcaggctgttgcagccgtctacgatggccgcctcctccagttcctttgggatggagataaaataagaccggagcaggaacatggtaaatgggatgcgaaatgccacatagggcaatatgatcgcccactgggtattataaagcttcatggactgcaaaatcttgtaaagagggacaagggccacctgctcggataaggccataccacccagcaccagaaaaaagataaaggtactgccgggaagctggaacctggtcagtccataggccagaaaggaactgatgaacagaatacataccagggataccgtactcaccagaatggaattcttaaagtagttaaaaaggcccttgttccatgccgtcacataattgactgccatccattttttcggcagggccagagaatttaaaaacatttcctggttcgtttttaatgagttaaggatcagccacatgaccgggaaaagtatgacgcacaccagaaaaatcaggaaaatatgcagcaatatccttaacagaaatacctttgaattattaaaatgtttcaacccgcatccctcctttatgcctcaccggaccttgaaaccttcagctgtatgatggatgcggtcagggttatggcaaatatcaatactcccgttgtggccgccatacccatatcatcatgcaggaacgcattctgatagagaaacaggccaagcacctgggaattgtttccagggccgccgctggtggtggaataaacctcggtaaataacttaaatgctccgataatggtgatgatggagcataccagaagctgttcctttgcaaggggaagggatatgcttaaagcccttctcacaggccctgccccgtcaatgagggctgcttctaagtaatctaccggcacgttttggaaagccaccaccataagcagcgtgatataaccggtaaactgccactggctcatggctatgatacagaaaatggccagccttttatctcccagccaggtctgctggaactgggaaagtcctgcattctttaaaaaagtatttaaaaggcccacctggggagaatagacgaaattaaacatcaggccaactgctgtcagggagatcagggatggaataaaataaacatttctgtaaaatcctctcgccctgccggtgagcctgctctccagcaaaagcgccagaaccgttccaaagcccacctgcacaaggagggatatgacgcagtaatacacgttgtttctcaacatgatgggaaatacttcattggtaaacaaacgcctgaaattatccagccctacgaatttcatggtggaggagtaggatgacaggcggaaaaaactgtatatgcagttgactatgataggaatgtatacaaagcccagcaccataaaaagccccggcaatacatacagatatggcatgaatttcttttttttcatctggatcccatcctttttcgtgaacagggagcgtgatacgctccctgttaagctgatattcttttcagaaactaagggaccagggactgtgcttcctttgccgttgcctgaacctttttcatggcctcttccggggtaacgtctccgttggtaatatcggaaatagcggtcagatatgtatcacatacggtggaatacagggagctgtcaaaccatggtcccatctcctttgcagaagcaattgccttgtatgcgtcgatcagggagggatctttaaggcctgcatcaacacccttggaagcattgaaccagcccacctcttccgcctgtgcggcaccgacttccggtccaaggaaccattttaagaactggatgcattcttccggatatttagtcttggaggaaaccacaaagccttcgggagaaccggtgagaagatccgggtttcccggcccttccacaaccgggaagttgaacattccccagttcaaatctgcattttcctgtttgatgtttgtgatttccaccagttcggcgtacagcatggccgtctgtccctgggtgaagccaagccttgccatatcatgagtctgcccgttgacgccgggattcatgtaaggcacaagctgctgataatattccagagccttttcatatcccggatcagcaaattcccctgtcttcggattatagtctctggctcttacatcgtctgccacaagcatctggtttaatgtgcctacataatggcatgcaggccactgatcctggtttccttccgcaatgggcgtaattccgccggctttcagcttgtcgcataaggccagaaattcatcccaggttccaggaatttcaaggccttccttttcaaatatatccttgttatagaaaaacagcttgccgtctaagcggaaaggaacgccgtagatcatcccgtcatcagtggtatactctaccatctgagtgggcagaagagaatccttccatgccgtatccttttccatgtacggtgtcagatccaggatcagattctcacggataaagcgttctgagaactcaccgccccagctgaaaaagatatcaggacattcatcggagcctacgacgactttgatcttttctttatagggctgattctgggcactggtgatctgaatatcaatatccggatgggccgcttcatattctgccacctttttctcaatgaatgagttacagggatcatcgggaaaccggtggaacagcttgatgaccttcttatctcctgcaagggctgctgccgtggtgtccccggaagcggactgtgaggattcggcggaggctttggcggacggggattggtcaccggtattgccgctgcaggcagtcatggacatggccatgatgcaggataagcctgcaaacatcgcttttttaaagctttttttcataatttactctcctttcttgtatccggtaaaatagttgtgaccgttatgtattgtatgcatacatcttattacaacttggatacattatattatgatatatcatattttgcaatagcttttttcattttattgtctgttttatcccagagtttatgcatatgcaagttctgcatagtaaaaatgacgaacatttaagaaaataaagttttactttcctaaatccttcgtcatttaagcgattattttcttttattagatcccctttgttccgttacgtaaagatggtcagtttatatctttccggatttatgatcagcttgctgtaatgaatgacctggccattctcatccatgacctgatccttgtgcagcaggaggacctggccttccctcaccttcagatattctgcttcctcttttgttgcatagcagatttccacggtcttcaccgcatgggtgggcacggtgtcatgtctgcgcagaatggaatacacagagcttgttaaatcttctcccatgagataggagtactttgacggaaaatacccttcttccagcataaccggttccttgtcgcttttccggatccggatgatctttaacacacggtctttttcatttatatgaagatactggctgatggagacggaggctgatgtccattccagggaaaccatttccgtagacgccgttttcccgtcattttcacacatctccgtaaagcttaaaagcttgttcatgacccggttcagctttttcgcagcaacaaaggtaccgatcccctggtgctttgtaacatatccctcgtcagccagtatctcaatcgcctttctgaccgtgatcctgctgacgtcataagcctggctgaattccagctccgtcataagcttgtcattttcttttaatctgccttccataatctgctgcttaatgtcatctgcaagctgctggtacaaaggggtgattgaattcttattcatatttctcctttctcaactctgtccttgacttgtatcatacatcttataatatcacgcccatccaaaaagaacaattatatttcagcctaaatttcaactcatcatccctcatggtgctttatcctttaatcgcaaatttcgacataattttacagtaactgcattgaaatattaagaaaaaagttataaaataatcataaagtttaaagttttttccattattggaaaatcaggaggaggacacttatgaagagatcggttcggacagaatttttagcaattattatcccagtcatcgcagtctcaatgatcctgctatcattcctaggttacatagctgccaaggaaataataagaaaaaacacccaggagaaaatggagcagagcctcacatctgcggtggaaagcatccgggtatccttaagtaaaaaccagaaggtggcggagctcctggcaaggtcctttgaatcagcttccgatgtcatgaaggaggacaactttaaaaacgtactgacttcctttgcaggcaccaataaggagacttccggagccgggatctggtatgaaccgggacagatggatcctggtacccggtatttttcacgctactgcatgagggaaggagaccaggtggtctatgttcccgattactccttgggagacggtgtttattacaatacccaggactggtacacaagcgtccagaacacggacaaaagcgctgtctggtcttctccttactacgatgatgttgccaaaatctccatggtgaccgcctctgttcccctttatgataaaagcggaaagtttataggtgtatccacggcagatatggacttgacagaccttcagagcatggtagcctcaattaagccgtatgcagaaggaactgcctttttgatcgatggaaacgggacttatattgcaagcgaagacagttcaaaggctttgaaggtgaatataaaggaggaaacggatccttccatggcagccctgggaggcgaaatattggccaagagagcgggagccggaaactataaacagaacggggaaacctacggtatctggtacacccagataccggaatgcgactggatcatcgccatcgcggcccctgaaagtatcttatattctgaccttcattcccttggacggaatttaatccttttatgcatcacaataactctcatcctggtcaccatgctctgtctgttcatcaacagccggatcatacgtcccttaaaacgccttcaggatgtatctcaggagatcagtgcaggaaatctttccgtaatcatcaaatcagcctctaacaacgaatttggacacgtatcaacgtccttaaaggataccgcagaaaggcttggcacctatattgattacatccatgagctttccatggtgctggacatgatcgcagaagggaacttagattttaccttacagttggagtattccggggaattttccagactgatgcgctccattgataacatcaagcaatcccttacccacaccttaaggcagatccacctatccgccggccaggtgtccacaggggcctcctctatctcggaaaatgcccaaatgctggcccagggaaccacggaacaggctcataccatggacaagcttacatcaatggttcagaatatttccgacaatgtaaaatccaatgcagagcatgcagcccaggcaagtcataaggcaaaaaacgtggaagcccacatgcaggcaagcaaccagaaaatggatagcatgctgcaggccatgaagcagatcagcgactcttccggcaaaatcagcaagatcataagcagtattgaggatatcgctttccagacaaatatcctggccttaaacgccgccgtggaagccgccagagcgggggcctcgggaaaaggctttgcagtggtagccgatgaggtacgaaacctggcaagcaaaagtgcagaagcagcaaaaaatacctccggtctcatcgtggaatccgtttcctccgtggaaaacggcacccagattttaaatgatactgcaaggaccctttccatggccgccaacggggtcaatgaaatttccggctccattgaacaaatcagctccgccaccaggacccagtccgatgccatcacccagatcgtccttggcctggaagagatctcctccggcattcaggcaaactccgccacctccgaggaaagcgcttctgccagcgccgagctttccaatcaggcacagaatctgtttaagcaggtatcaaattttaaaattgcggaaggaaaataactctggtacaaagattattaccgtccgggtttaaatttcggaatatttcccttaagcggtttataatattaattaaatcacatgccatttaggggatttatatgaatgaggccaatatgggcaagaggggaagcataaaaaaaaccggcagtatcctgcgcatcgaaaatgccttagtagaagacatctatacgcctaacagcaggaccggatatatcctggtttcctacgtgactcccagccaaaatgagatggtctatattgaccttctccgattgaatataggctgggataccattttaataaatcagttcggcgaccccatcagtttatgtgtcgtcagaaaggggatgtgggtcaatgcggaattctctgccgccatgacaagaagcattcctcctcaatccagggcttacagggtggttgccatggtgcagaaacctttattccgcacaaccacggaccggatcgcctccgttgatattgaaaacagcttcataaacacaggcgatcctgaggatgagacagaccagataagatttgtgatttccggggctacggaaatcctggaccagaacgacaatcccattctcataagcgaccttaagccagggcagctggtccggatcgaacattccaactttcaatctgccagcattcctccccagtccacggcttatcgcattaaactggttactcctgcccaaatataaggaaatatttcataaaaaagtccggccgaatgatcacttcccatcattcagccggactttttgcatgtcagaggacttctgactccccatacagacaggaccacgatcttctcactgccgctgatggctgccgctatgggatctgtatgtaattggggcaaaaacggcctacaatccccagaatatatcctgagctatggaggctcattccttataatctcctcttttttcgaccacatgataaccaatggaggcaacacggtttctcagacagacattgcactctgccgcttcctcaccggtacagatcttattgtcatacaattcatatttcttccggacgccgattggagatagatttggcatcagcacattggctcctgataagatccccttttcccgccccttagggtcaagggtccctaatgccgtggtagagggcagcagcgcccccggcagcatcagccttaatatccctatgagaaataaggtgagatcaacgcttcctgcagggaaggacgcaaagggcgtatccttatggggataaaaggtcctatgcctaccatctgaggagacagctccttgataaactctaaatcttccgccagacattttgctgtctggtgaggggagcctaccatgaatccggttcctacctgatagccgatcttctttaaatttcttaagcattccttcctgttttccaaggacagggaatgaggatgaagaagagaataatgttcctcatcagccgtttcatggcggaggagaaagcggtttgctcctgcttcataatatctcaaatactggtcatatgttttttccccaatggaaagagtgatggcacagtccggatacccttcccggatggtttttacaatgtccaccatcacctcatcagtaaatgcagggtcttctcctccctgcagcacaaaggtcctgaagcctaatccatacccggattcacagcaggaaaggatttcttccttgcttaaccggtaccggctggcattggtattgcttcttctaatgccgcagtagtagcagtcatttttgcagtaattggtaaattcgatcagacccctgataaaaacttctttttcatagtgatcctgactgtaggaccttgccagggaaaataaatattcgctggcttctttatcataattttccagcaggtaaatgaactcgtccttttccaggttatgagtttcatacagtttatcaatcagctgcttcatatttttactccttgctctgtagtttccgccgctgcccggtcttttccgttccttaccccagattctccacaagctgcactctcatgccattaggatcctttataaaggcaaactttacgtgtggattgggctgcaccggttctcctaaaacagccgcgccttttttcttagccagggaaagggtctgatcaagggactccacttcaaacccccagctgatatcatctcccacatggatttccctgtccccgctgcatatgaattcgatttgtgtttccccgtcacctaaaaatgcaatttcagtaccagggccggcagggaatcttttggttaccttcaggccgataatctcctcataaaatctgattgactcttctaaattcttaacatttaaagtgctccagcaaaacttcatataaattcctcctgttataatcatattttgtattttatcttagtccatgatgaaagggtagctgtacttaatcataccagaataacatgtttattctatcattttctatataatagttaaagataattttaaaacatttttttccattccctcccagcttcaaagcagtagccaaaagtataattttattaaaaaaggccccaattgcatgagatttataatactggaacccattataatataaaatatagaatcagagaccttttatcaaatgtattcttataacaggaggactcccttatgaaatttgaaagcaccaaagccagcggcagcagttacttcccctgggaagaaagcgccttccacgtatatggagagcgggaccgtgaagtaatcgcactgatggccaaccgttttatcggtcaaaatccccaggcgccttatcagtaccggctggatttcacatccggcatcctatgtaatacaaaaggctggtatcagtttgattttgacagccgtttttcccaggctgccgttggtgaagtctgctatggggcaggaaatttatacagccacagtcaaaccgtctcccagtttcagattcagtgctgcgggccggccgttctatgggtaaacggagaaaaagtatttcactctgccccgtctcaggaaggcttaaaatcctgcagtacatgttctattcctcttgtggcgggctttaaccattttctgttggaaacggaaaaaacggagatcggtttcggcctctctctgcgccatgcacagccccaatggcagccctcccattttacgtcgcctttgtctgaaagaaagggacaggcaggctttgtttacagcgctcccattggccgggagtcagcagatgtttcagcccttattgatggttcttttgaggggattacctggtttcccaggcagacgtatgaggagccagcttcctcctgccctttatcccggattttcggcctggacagccagggaactgctgctgccaaaagcaccttctttcatgtaaattccggcaaggtcctgataaacggaagctccagagcgccgcttaagatctgtatcaatgaaaatctggccctggaatggatggaagggacatttgaaaaagaagttttcctgcccagaggatggtatgaggtcatcctgctttgcgagaagaaagcaggcgaagaaacaggacttgccattgaatttcaggatgaatgcggtctcctgcccctgtgcgccggggtaaagggatatgaaggggaatggatctataccggtctttttgacaaagagattccccccatcagccatttcacaggcatggatcgggtgtactccggatcaaagggcacctgctgctggaaagccgacttaccggactcctttgtccggatatttgcggagcaggaattatacggcaaatggacctatccctgcggagttaccctttacggccttttaaaagccggagaacactttggccgtgccgactggcttcaatacgtgcaggagtacgcccggatgacggcggccatatacaattattccacctacgacaagtccgtgtttggctacccgggtgtgaatacccagctttgctggctgaccgagttagatgactgtggttcctttggttccttcctgctggaagccaaccggcagaagcccataaaagaagttcccgccctggcggatgtgatcgctgatttcatgaaacaccggcagcgcagggaaaaagatctggtgttctccagaaatgacaacaccatgtggatcgatgacatgtacatgagcatcccgtttttatgccggtactaccagttaagcggaaaagaggaatacttaacggaagcctgccgccaggcacttctgtttaaacagtacttttttatgcctgagcagaatctcatgtcccacatcgtggacctggaatataagaaaatgaataagatcccctggagccgcggaaacggctgggttctgctggccttatcagagcttctgctgatccttccaaaggatcatccggagcagaaatcagtggcagagtttttcactgaaatggcagaaggcattcttaaggtacaggatgacagcggcttatggcatcagatcctggacgatccttccacttatgaagaatcctcatccacttccatgttcatctgcgccctttccaggggaatccggctgggaattttaaaccaagagctttgccgggaaagcatctcatccattcaacgggcatgggaagggatgaaacagcgggtgatcgaccgaagaggtgacctttacggggtctgccagggctccggctgttccttcagccggtcctattacaggcagcttggatggcgttttaatgatccacatggaatcggaattgccattctggcgggagtggaaaagctcacattggatgaataccttcagcacaatcccattcacaaataaattctgcgaaggggcaccatggaatggaagctactcaattctgtttcttccaagatcctttgccttgtataaatgtttgtctacaagcctgatcacgccgtctacagtggtgcattggtatccttgcagactgcatgtattccaaagctgcaggtcagcctgatcttctgatcttctgctgtaaattcctttttttctatcccgctcctgatcctttctgccacctgttttgcagcatcaagatcacaattggtcaggcagatgaaaaattcctctcctccaaacctggccacccaatccttgccctttcgcatatagctctccagctcctttgacaaatcctttagcacggaatctcctgccgagtggccgtaggtatcatttatttttttgaaataatcaatatcagcaaaaacaacagataacggttcggatccacgatccgcataacatcataggtcttttcaaaaattttcattttatccaataaagcttcatattccttcatttctgatacctcctgattttagctgttgtacctgaatgattcctgttcaaaccagaaacggtcaaaaaacacggattgcattacgaaccttttttgcttcatacagagcacggtccgcatgaataaaaagccttaccgtatcaacctggtccgatattgccgcaagtccaaagctggccgtcagcttaagctttggatagtcctcaaaaaacaggtgattcacccttgccagaatctttccgcagatggactctgcctcttccatggttttatcacggaacaataagcagaactcatcacccccataccgaaagggcgtcatatccgaacgaaactctttcaaaaccctggcaaattctattaagcagcggtctcccacatgatgtccccaggtatcgttgatacttttaaatctgtcaatgtctacaattgcaagaatatagctccggtccgatgccgtatcttccacatatttcaattcattccggaatgccttccggttgtatattcccgtcgtttcatccatgtggacgctctgctgcaggagctgccgctcaatttccttttgtatgcccgcactgtttttcctccgctcaaaccggatcacggccatacaggcaatggaaaaggcggtcagcacgaaaatagaaatcaaaaaatcccccatccggtgggtgttttcaaaaatgctgaccttatccgcatcccattccatgaacagctcggaaatgataatggaaataatgctggtcagcgccgtaatacatgttacacgataatccgcatagatcgccgtcagcatgatggcgatggcaaaaatatagtaggttgcggtaaacgtgctgtgcaccgtaaaaagaacgaagccgatccccacaaagataagggaaacggaataaattttctggctccgtgaaaaatactctgacttcatgatcagcgtttcgcctgcaatacataggagattgaccacacttggaacgatcaggaactttatgaaatacttataaaccgttgttgtcagcatatctgaattaatcaggaacattcccattacaatctccaccagcatggaaaacacaaccaggataacggaggttttataatgcagtttcagccagctttcatcaattcttgtatattcatcctgtactgccctgatatacatgtcatctaaactttcttcatctatgtgaaacttaaagccttcaaactccacgttcttacctccaggtgccatgcatgataatgatttataacaattcaaaaataatctttctcaggatgccgggcagggacacccggttacaggggagatgcaccctcctctttaattatatatctgattttcattgaacggtcaaataaatttatgcatttccacacattttaccgcaaaacaggagttttatttgccttatcctcctcttcttaacctgtccgcactgtaatggaacagaatatgcaggaacaatcatctgtttatatgaaatcggctgcatccaggttaaacaaccctggaaatgcaaccgataaatcaatcatcatgaaaagttttcttctgcagtggccccattggcctgaaccttctctcctgctctttaggaaattctgcctttttttaaccacttttcaacggtttctgcatctcccggcttagcaaaataatacccctggatataatcacagcccatatcccttagaatctgcttttgctctgccgtttccaccccttcggacaccacctttaagtttaagccatgtgccagctcggtaatactttttattacctgatgctctgtttcactttcaagagcctttcctaaaaatgacttgtcaatttttagaatgtcaatgggaaggacggtcaaatagttaagagaagaataccctgtaccaaaatcatccagggcaatgctgacaccaagtgatcttaattttttaagaatctcaatattgttctgggaaaattccaaaaggacgctttccgtaatttcaagctccagctggcttacggggaactgggtttcattgagaacctcttttaccagatcatagaaattctcattgcgcagctgatgtacggagatattaacggacagctttccaaatttacagccgctgtcaatccaggcctttccctgcatacacgcattttttaatatccagttgcctagaggaatgatcagtcccgtgtattcagccacagatatgaactcaagaggcggaatcattcccatttcttccgaatacagccttgccagggcctccactcctcttatttcattcctcaataaatcctgctggggctgatagtaaatgagaagttcatcctttgccagagcttctctgatgcatccctccacattggattttctgatgatctcatcatgcatctgtgcgtcatagatgcaatactggttttttccgctttcctttgccttgttaagagccgtatccgcattccgcagcacatcatttgccgtctgcccggcttccagacaatggacaacacctatgctgacagataaataaacggacttatccatcaggacaaacggagcgtcaaagatagagagaatgttctggcagagcctttccacagctctgatatccttgtggtccctgataagaattaaaaactcatctccgccaaatcttgccaccgtattttcctggcctaagatctgggacagccggccgcccacctggttaagcagccgatcacagaaatccagcccaagcaagtcattgtggatcttgaaattatccaggtcgatcatcaggatagaatccctgcacatggtttcctctatgctttctaaggtttcctcaagggtgctcataaactgcatcttattgggaagtcctgtcagcatatcataaaatgccatgtattccatctttgattctctttgtttccgttcttcaatgttggacactgcccctgccaccttgctgggaatgccttccccgtcaaaatagacctttcccttgtttaaaacccaggtgtaagtgccatccttgctcctgatgcggtattcccggtgaaactctctggtctctcctcttaagcaggaatcaaaggcatccagcactgcctgataatcctcctgatggatggtctccttctgtatgaccgcaccgagtccatggccttctaatgcatttccggtgatgtcgatccacttgtcggaagtgatgatctcatcggttatgaggttccactcccatagcgcgtcattggcactgtcaagagccagggtgtagctttccttcagcctttccagttctttgtgcaggcttgcaagatgctggaggttttcatcctttttgaaaagtcccatctgcatataaatgagaattcccataagaaacaggaccagcagggaaataaagccaatgagcgctccgttggcattgacgctgctttcttcctttgacagcttcatggtccagtaggtatccatgaccgggatacggatgatataggaatccctgtccttccatggtgaagctccccagataagccctcccttgtggttaaaaatgctgatgtgataggaatccggcatcgcctctttgatcaccttatccatatatgtattaaagttaaaaaccacaataaaaaatccattaaactcattgtctttataaaggggataccgtattaccagccccagcagatccttggtatcctttaaaataaagggatcgttgactgttgtggtcctgtttttgatagctttttcaagggcttcctccacctccgggcgccccctaagggaagcacccagggtgtaatcatacacatcaggatagaccatatctgtgaccgtagctttatccttatgctggatgtagaggatgtccgggttatcctccatatatctggctgccagaatatcgaacttgcgcttatcaatatggtcatcaatttcataattataagccagggaggttaatacgccttccgttatggcaatatgctgctgcacagagtaggacacggattgtccgatgcttgaaagaagataattgctttccgcctgctgggaacgcaggagaacaaaaacaatcgtcatgaaaatcgtgagcataattaccgtctgtacggctatatatctggaatatttatttctcatcacagcccccctcagtgccggtccatttttccgtaaccagcattcttttctatgaataaaaaaataatctgctatgatcaagaatacagcagattactttttccctcatactccattatgcagtatattaaagttttctgtcagaattcctttgtatccagctcagtttttgaatgaataccaagtttgcgatacacacttcttagtattgttctgacagttgcttcggatatacaacttgtcggcaaagctgcttctgatgccccactatttccagattcttttcatggtcacgcggatattcccaatccgcttcgccactcatttgattcagttaaatatcctgtcatactttcttaatttcctataatttaccacaaaattcgacatttttcaacacatactcatttgcagcatattgcagggaacagttcctgttaattttataacaaggcctgtacttcctattttcacacaaaaaagaggctgtgtttattggtgatgatcacctgtaaataaacacagcctcctgcttagatcactttttccggccttcaaatatccctccatgataacaataataacggtccgcgtccagggatatgagccttttaagagaagccttggccttatgtaggtccagggtatactgagggtttgcgataaccagccggccgtcattcaagactgcggcgtctcctgtaataacggaatggctctcttttaaatataaggaaatatgacccggcatatggcctgaagtatccagaatctcacagcctccggcccagtcaaaatgatctccgtccttgaccgtccgatccactggaacgggcctgacctttcttaaagattcacagaattggattccaaaggacttttgctcttccggcagcacattcagcatttcttccgcctgcaataagcgcagagattttctctcaccggaaatatacctgctttcctcagcgcctgccacaacctccacatccggatatttttcctttaattcatataaggctcccatgtggtcatcatcatggtgagtgatcaggactttcgttaaagtgcctggatcaattccctttgatctcatctcagtctctaacaacggcaggaaaccgggatatccgcaatccaccaaaacgacttcactggagcttaataataaaaccggatgaatggtccggttttcattcccatactgaaaattgatatccaacataattatttggttcataatattctacctcacaaaatttactgccgatcagtaatgattatatagcttaccggccttttcggcaatgagaaactgttttttctgatcagttcctgatggggcaaaaccagatacctcttttcacccatgtctgtcaaaccctcagcaaaccgcggaacgccctgctgctgtaaaagctggacgcgccattgtggtacaggaaaacatgaccgtagcggaagtcggcaaagacggcgccgcccagctttctgatatcagaaggcgtcttcacccagctggatgtcttcctgtcaaaattcccaagcttctgcagctccctgtattgttcttctgttaacagttcaatccccatatcagccgccatacccacggcactgccttccgggtacaccctttccgctccctctcctcctgtccttcccggtcatagcagatgcttctgcggcctttggggctttcatctgaacagtcacaaaaaatgtattcacctgctgcctcatctaaggcaatcacatccggttccccgccggttctttccatctcattcagcgaccagagctttttaacattcccctccagtctttcctgcacgttttcccacttaagatctttatgacggttcatgttttcctcaaaccgttttttcagtatgtgaagcagttcttcatttgacatggatattacctccttacaattccttttcagcaagcagcggactggcctctcccatggaaaacaggctgagtctgtgaagcgcccttgtacacgagatgtataaaagctttttatcatcttcactgtaataattttccccgttgacatcgcatattaagacggcatcaaactcaagtcccttggacatatatacaggcatgataaatacaccctgcaaatctgccgtctccccgtttttcactaaatgaacatcagctttgtcctttaaacgcttaaacaaatcaagggcatttttttctgttttacagatcagcccaatggactggcagcctgcttctatacaggatctaacctccgaaacgatcatattatgaaatgacaattggtcttcggctgtatatagcttcggctcatctccttttcggttgaagctctttatttccgtacttccctcaaggaatcttaaaccatagtttaaaatctcatttgtacagcggaagcttttgtccatggtcacaagggaagactttttcttatgaaagattttcctgatctgttggtataaggataaatcttcctttttctcaagggtctggttaatatctcccagaatggtgaatttcgcttttgggaacagtaaattgaatatttcaaaatggagaggataataatcctgagcttcatcaatgactacctgttttatggttttgtattcgttgactccgtttatcctcaaattcaaataggtgaggacagttgcatcgtcatagtacagcagaaaagtatccagattttcctgtgtaaaagccaaaatatcatccatgccgccgggaagctccacaccttctgccaggctgtagaaatattctttatcatgaaacagttttctatacacagccttcacgtcaagttccatgaatttcagcatttcttcctttatcagaagcttttccggctttttcatacggtatttcttggactcactgatcagctccagaatatattcctctatcagtttcagcctcacacccaaaagagtctcatttcttccggataataccttttctttcagcatttctttgcttatgatgcacttcccatcatagattacatccttgaaatccatccatttatggggaaggtcatcaataaaacggtccaatatttccagaaactgacgggaagtcttgaactccatggtgctttttatcatatccctgtattttgaatttgaaatcaggttttccaaaaactgatttcttgtctgcacctgttcattctttaaagacaaagcaatgatatcttcaaacaccacagaaaccacatgatcttctccaagttcaggcagcacattggaaatgtactgctcaaataacgtgtttggcgaaatgatcaggatattatcagcagacagcctggaggtaagtccctggtacataaggtacgcggccctgtgaagggcaatggacgtcttcccgctgcctgccactccctgcaccatcattaaatcattttccatatcccttataacaatatcctgctccctttgaatggtttctacaatggtcttcattttgggagaagtattttgcgacaaaagcttccttaagaattcatctacgatctgcacatcggcgtcaaagaaatattccagcttccctttgctgatttcatactggcgctttaaattaacttctcctgttatccttccccaggagcatcataaaaagcctgccccaggacaaagcggtaaaatacgcttgcaatgggggatctccagtcataaatatagaactcgtttgtattgtctttctttaaggaagaacgtcctatatagattttttcaaatgtatcctcatcctcgaacctaaaatcgatccgtgcaaagtacgggctctggatcatgttctccagcagtgcgatcttattttctaccgcttcataatctgcgattttatctgtaatgggatttgcatactgattcagggctgcaagggcctcaaagccttcactgctccagaggtctgatatggagtgtgaagtattctcccgcagctcttgcttggcagaaataatggccgacttgttttcctcattgcgctccctcgcctgatccagctgttccctggccaaggctatggtttgttccaacctgatattttcaagttctaattccattttactattttccataacaaataccacctctcttttagaatcggcagaaaatccatttcctaaactgccattcaaaaagtctagcacaaccggaatcagaaaaacagtcttgttgttggtaattctatgtgttacaattaaggtagagagaaaggcgactgttcttcatgcacaatcacctttctctctttctatgtcataccctgtatcaatccggccttgctcctgtcatataacagctttctttcctgatatgcataagccgaaaaattctttgcttacggcggcagactttaattccgactgaccaagcagtgttttaatctcatcaccggtataggctgcattgtaagaggttaaaaaccccggacgtatggcctttggcctggttgaaaaataaataagccatttgatcagagggttcacatcccgccgcatgtctgtgatgcaaaaaagtcctcccggctttaagaccctgtgtatttcatggaacacctttatgggatcctcccattcatgaagcgacccgttggaaaaaacagcatcaaaggaattgtctgaaaagggcatctccatgcaattgccttccacgtagcctgcccggttttcaaaaccataatcccttgcatttttctccgcaagcctgatcatttcccggcttatttcacatcccgtaagagctgcatcaggaaacctttttaaccactcaaggccaacatatccgggtcccggaccgatctctaaaacctttccctttgtgattcctgctctgataaagctgtccacattgttccagcctttatcccgcatgatcctggcaaaatcgtcgaaaatttcaacagtcagtttatcctgaatgccttcctgtgtttctatgatcctttgctttttcataatacctccctataaattcaaacgattcagtgattcttccgcccagtccagctctgcctgaaaatggtgttcatgatggctgaatatgatgtggaccatttctctgtcctcatccggaacaacatgcatggtttcttccctgtgctttttaatattggacagggatgccttcagtttatccatataatccgccaaatggcttacaagctctgccttttcaatataatcggcaaagtaaaaaacgccgtctgaaggaaaggtaggccggtactcaaattcaagcagtcctgcaatcatgttcttaaatgccaggattcctttctccgtaatggaatagatggttttttccggcctgccgccgggcttttccctgtttgcggaaagcaggccgtccacctccattttttccagatgataataaatggtgggaagtttgatctgcgtaaagtcggaaagctgctctgcaatgatttttttaatctggtatccgtgctgtgggccgaatctttgaagtaaaccgagaatataaagtgggatcataccattcacctttctgaataacaaattagtcagtcctgactataattatactcagcactgactaattgtcaagaacaatattgtcaaccggatattcgcagcctgcttgtcattctcctgaccacgccttttcaagagcagcgatatccagctttttcatttttaaaaatgcctctgtgattcgtttcacttcttcttcggttcctttggccataacgtcatccaggttctcaggtacgatctgccatgataagccaaactggtcttttacccagccgcattgctcggactcaggaacaaaggaaagcttatcccagaaataatcgatttccgcctggtttgcacaagggatcataagggagaatgcttcattaaacgtaaaatccccgccatatccatgatccatggcaatcatctggtgcccctgaatattcagctcgctgtagtttatctttgcccttttatccatagcctcccctgcctgaaaatggtttacgtatccttttgtggaaccctggaaaacggaaaggtagtaattcagggcttcttccgcttttccgcatgcgtctcctgaaaacagaaaggaaagcctgatcctttgatgctcttccatgttctcaaccagcatgagctgccagcttaagccatatttatcctggagccaggcataacgtttgctgaagggatactctcccaaaggcatgagctccattccacctgttgataaatgggaatgcagcctgtccacctcttccggaccggagcaggctaccataagtgaaatcgaggggttgagggtaaaataaggtcctgcgctgatggcagaaaacctcatgcccgcaagctgaaactcaacggtctgcgtatctcctgacggagtgtcacggattatgccggtacgaaggattcttgaattctcaaaaagttctacataccattgggccgcttcaactgcttctttgtcgtaccataaatgtgggattactttctgcatcgtactacctcctgaatttttgcattttttaaaataaattatgaaattggggtaataaataaacaatataattacttaatacaagtatacacaagagcattcaatctcacaaatatattttattttcaattaaaaaagcatactgtttccacttgaccattaatatgatgagagaaatcagatggcggctgccgaattactaaaaagtagtccggcagccgccaaaacccggtaacggtcaggaagaaatgatttgaaaagacataagaaaagggttgtactgaaagcttatttttgcgaatcaagtatgaataaggacgcatcacggcccataaacagattgctgcctttatggaatgttctggaccgaatatgcttaaatcctatttctaataaatcctttgccagcttctcctggtcaaaaccattatgaaccagatctgaaaccacttcatggttcttgttaaaatcaataattatcaaatgccctcccgggtttaaaacatcatacagctttaataaaactgacttaaagtccctgatatgaagtaaaacctgaaccataaaaatatagtcagtctgcaaatccgaaagactgtccttctcaaaatcaaagcacaatgcagctgcattctgtacattggagccggaaatcttttgatttacctggttaatcatgttttgtgatgtatccagaaacagtattgatttaaaatcatccagcagattcatgcccacaagacctgttccgcagccaaagtcaatggcgtttttgttctcagcaccagccaaatattcacgaatggcgtttgatgacacctttccaatccggatcctttcaggagtgtcatatatatcagctatcaactcaaacttatccgtatttcccattattcatctccaatccaccttaataaaggtctgatgtcagcctgaattatccccggccgcttacggcacataacaacaggcggcagtttatggcaggcaattacatgcaggttatcagacggcaatgctcctggcccacttaacagctttagaagtatttccctcacgatttttcttaggttccacgaaatctatctcacagatgaattcattgccggaaagctccttttttagttttgcaaagcactttttggctccgcctcctccgtgactggcaaacagcgcaatccgtttgccccggattttatattggctgataaaactttttataggcggcgcaaaggatcctgcccagacgggcgttccgattataatggtatcataacggttccaatcaattggctcgtttaccagatccggcttctctccaaaaatgacgctctttccgccaaaaaaatacttcttaaatccatctgccggatattccttgctggtttttaactgggcaatatcggcgttcatagtttccgcaatcttttctgcaataaattttgtgctgccagtaaatgaaaaatatacaaccagagtgctcataacgattctcctcgtataataagtttgtagccaggaaaaactggttattggcttattctttttgtgatatagatgaatggaagcttaatgagggattcctctcttcccagctcattctatatagttgacagttacattgtcaatgggatattattgatcagcttctttccctgaaatgactttctttgcctcaacagcccaatccctcattgcagaatatatataaacgccgcagagcgcggtcagcttactgtaggagcagtcaatatccttgtctttgaactgctcaacaagctccatatagccgttcatatccttgaccagcttatcattccttctgataaaatcgtccagatgtccaagcagcacctcaggctccgtattctcaccaaaggagatcttgagtaatatttcgtaccttatcttctcgatttcaggctcctcacgcagccagtctgaaagctcctttctgcctgcgtcagtgatgctgtatacgatctgcccccgcccatttccaggctgggtgcgatcggagctggcggccagtccctcagccaccagtttcttaagagtgggataaatctgcccaaaactctcctgccagaaatggctgtattcgttctccagccattttttgatcgtatagccggtctgcggcatgcgggcaagcattcccagcatcacgtattttgatttcccagcattctctctcatctgtacaccttctgtctatttttatatcacaataatatatcataaagatatatcgtgtcaagaccttttgatgaaaaacttatatcacctcctcctataagttttttattgattaatccagctttctgacatcacttgccatcaggcaaatgactgcaattccgattattaaaatacctgacaggaaaaaccaatggtttacaccaatccgatctgcaaaaaatcctgagaggatcagaccaatgggcatggccaaagacatgatgcttcctgtcagagaaaacacacgtcccaaatattcaggcttcaccttctcttgaaaaagagccgtttgaataccgctgtaaaagggaacggaaagacccatcgctgcgcagcagattacaaatacggcaaatccgcctggaggcagcaatcccgagatggtcaaactgaatcccatcataaaaatagaagctgttataaatgagaccctctttttcagattgccaaacagtcctaatatcaaaccacctgccagcataccggaagcgtaagcaatttcagtaacagagacatgcaccggtgttccgccaaaatattccatgctgatcaaaggataaagtgcattaatcggcatatagacaaacatatacagtgtgcctataagcagcagcacaaataaccctctattttctcttaaaacagcaaatccttccttcatttccctcataaaattctgctttggtctttgctcctcaacacaaggtctgggaataggtacaagacctaccgtaatgcatgcaatgattgcgccagccacgtccatggctataatcgaattcaattcccagacagaatataaaaatgcagctgcagcaggactgagaatatagctcacagactgtaaagactgactgtaacctgcgcatctggtcagctgctcttccggtaccagcaggggcgtaactgcgcttaatgcgggagaatgaaacgctgtcccaatactccggataaacagaactgccataaccatccaaaccgataactcactatacaaagcaataacagccagcactgcacctgcggcagcaatcatcaaatcagcaccaatcatgatcttctttctatcataacggtcaacgaatacaccgatcacaggcccaaggactgcgtacggcagaaatccaacaaatgaagtaattgacagcaccatggctgagcctgttttttccgtaagataaaaaattatcgccatttgcagtacggcgctggtaataagtgaaattgcctgtcctgcccatatggtaaaaaatgcttgtttccattttaaagttttatttttcatatattttttctccttgcaccttttattgttgttttcacttgatttttggcaataaaaaatgcaggctaaaatccccaatgcgggctttagtctgcatattaacgttaaaaagacttagagaaaaaacgcatagcctcagatagctacacttcacccgtatccatgtcttaattcgtaaaataagcataacaaaaaagcccacctttgtggatgatataactgcttctttattgccagcttatcttaaacgaacagaatacatagaacgaatgccctcctttattaaccaaatttaagttattctatcatgagtcatatatgattgtcaatttccaaaaattaaggaaagtcattcggatatcctcactgaccagggggcagatcctccgctccgctgcttgatcaggttaatattcaaaaatagaaccatatcaggctaacctgatctgatgagcatggaatcccataaaataccagaaaaacccctcccattaatccagaaaaaagcccacttgcttttcagcaagtgagctttctatccttcgccttctatgaagttatttgcagtatattgctaccgcgtcacgtaaaaatactgcgcagccgggtgcgatcttatcgtaatacgccgtaaagcgggaatcgtccacatacatctgggtcacgcctatatgggcttctttgctgtaagcgtcccaataaaagcacagccattttttatgcagctcgcaggctttttgtgccagttctccggccggatcgccttgctcaaaggctgcttttaatgtcccgtttaaatctgacgtcagtttttccaattcagtatactgttctttgctcatgttcaaaaccttggcgttggaacggctgacgctttcgtccccgtatttttccctggcttcctccccgtattgacgttcgttatcatccaccagcttttgaagaaagccttcaaacttctcctgatcactcattatcatttctccttttttggccttaatggttttctctacattggcgaccagcagatccaattgctttcgcctggcaagcagggcagacaaatggctttccaacgctgaaagtccgtcaaagtcctttgaatccagaatatttcggatttcttccagcgataccccagctcacggtaaaaaaggatttgctgcagccgatcgatctccttttgtccgtaaatccgatatccattggaactgaccctggcgggtgtaagtaatcctaactcatcgtaatacctcaatgttcttgtactgacccccgccagtttcgccagcttattaatggtgtattccatcttttcacctccttgcaaaaaccactataaactattacgccgcgtgaatgtcaacagttttataaaaaattttcatacggaacggctgccgctgcacgattgaaatatggaacccactctgtcccttaagtcaaaatacccggagtccattaaaatggtaggcttgacctttaatgcatccggccttccgttttccaaacagccttcctctgcataagcagaaacgatttcaccaagaaacattgtaaaatcaaatataggaatcgtttgaatgaccttacaaagataattgaccggacattcctttatcatgggcgcctttcctgcttcatcataaaatgactcaaaaacatttgatttatctgtttgattgcccgtggcagtcccgcagtaatccgttttttctatatcgtcagaagaaggaatgtttacagagaagtatccattttctataactccggcagttgtataatgggaatttttcaacgaaatgtaaagcacaggcttctggcttacaactccataggctccaattgtggcataattgggctttccctttacagtagcacccgctaaaacagcgacatatggtccataagggatgtttgctatctttgtttttgtcatgtttattctcctatcaatcttttatatttgttgcagcaatgaaaattatataggaaaattttataaatatatagactttttctttcttatggattaccatatagatagagtgcgccccagggtgcactctttttttgttatatcccttattttatgattattatgccctcagcggtccagatccaattattgaatgttcaaactttttatctcccaatttataaaccttgcaatgaagaatcgtaaacttatatccgcataaataatgccgccattgctggcggcatatgaataatggttttgttttttgcatcttagggcagcttttttaacatgctggatatcatttttaaacaagcccatccattttcttacggtaaaatgtttcctgcgctgaggtaaatctcataccactcctcacgggtgagcttaatatcagcagctctgacacaatccttcagacgctctgaattcatggtaccggtcacaggctgcatctgggctggatggcgcagcagccacgccatggcaatggttgtgccgctaacctcatatttagcagaaatctcatcaatcttggcattgagttccgggaatttatcacttcccaggaatacaccctcaaaaaatccgaattggaaaggagaccagggctgaatagtgatatcattgatacggcagaagtctaatacactgccgtcccggtttaccgcctgatcatcaagcatattgacatgaatcccctgggagatcatattggcgtttgtaatactcagctgcagctgattagcgataatcggctgctttacaaactttttcagcagctgtatctgcatgggattttggttggaaacgccaaagttacgtacttttcctgcgctttgcaggatgtcaaatgcctcggcaacctcctccggctccatcagcgcatccggacgatgcagcaataacacatccagataatcggttttcagtctctttaagctgccgtccactgcttccaaaatatgctctttggagaagtcaaacgccacacctgggcggataccgcatttggattgcagaaacatcttttcacgcacagacgcgttcatgtgaattacatctgcaaatatttcttcacacacaccgccgccgtatatgtccgcatgatcaaaaaaattagcaccaatatccagagctgtctgaacaaaacgctctgcttcagacttatctattctattgatacgcatacatcccaccgcaaccgtgggcacctgtaaattccctaacttgattgttctcatgatattgaacctccttaacagatttagtctgtatacaataaaaaccgatgttaatgttctgttttctcctattgtgccagcttataaatctccagcacatcctgccaatacagcttttttaagccgccgatgggggcttcatcttcaaaggctgcgcctgtcgcctttttagccattaattcaagctggcttgcatcgattcccagttccccaagggttgcgggaagtccaagcttacagaaaaattcacgcaggcgcgtgatggcttcctggacaatggcgtccggatcgcggtagcttccctttacgcccatgacattgactgcaaactgcacaaacatgttgacattgtccttataaacatacttcatccacgcaggagtcagtacggccagacctgctccgtgagccacatcgtagatggcgctgagttcatgctccattccatggcatgcccagtcctgctggcgtcccatgcccaccaaaccgttatgagcaaccgtacctgcaaagcctacctcacaccaggcatcgtagttttggggattttcaaacacaagaggagcgttctttataatggtctttaatactgtttcgcataagccatccgttaagtcagtatgcgtggtgttggtaaaatagcgttcaaaaacatgactcatcatgtccgccacaccgttggcgatctgattctttggcagggtaaagaacaattccggattcatgatgctgagcaaaggccgcaggtgggggctgccgtaaccgtatttcagctgtttttcttcattggtgataaccgtatcgccgcttgcttcgctgccggcggcaggaatggtgagaatcgtggctacaggcagcgctttttcaattgctttaccctgttcataaatctcccagacgtcaccatcataatatacacccattgcaatagcctttgcagaatcaatagcgcttccgccgcccacggccagaattaaatccaccttttcttctttacacaaggcgattccttcatgtaccagggagaggcgtggattgggcactacgccgcccagctctacaaacgaaagcccattctcctttaatgaggtgatcactgtgtcatataatccgctctttttgatgctgcctccgccgtaatgcagcaaaaccttgcttgcatgaggttttaaaagcgcaccgatctgtttctccatttcttttccaaaaagtatacgtgccggtgaataaaagtcaaaattcagcatttgttttcatcctttcattttgttcgttttttgttttaccatgtgatcgtatcaggatcatgagaatatccgcagcatccttttaagccggcaatcgtctccacatcctcaggggaaagctggaaatcaaacacatgggcattttcccggatgcgctccggcgtgatggatttgggcaggggcaaatatccccgttccaggctccaccgcacgcaaatctgagcaatggacttgccgtacttctgtgccagtgactgcatttgcggaacttcaaaaatccttcctacaccaagagggctgtatgcctccagaagaatcgaatgatccctgcaataatccaccacttcatcctgtgtatcgccgggacaaagcctgatctgattgaccatgggctgtacctttgccgtctgcataagcgtttcaagatgatggggatggaaattgctgacacctatggcgcggatgagcccggctttatgaagctcttcaaaggctttccatgttccggcattggcctcctgccactgattgcggaacttgattgggttcggccagtgaatcagataaagatccagataatccatatccaggtttttaatcgtctgcttaaatgctttcatggtattttcatatccatgcatatcattttgcagtttgctggtgataaaaatatcttcacgggcaatcccgctctcctttacggcaatgccgacgctttcctcattaccgtaacctgcggcggtatcaatatggcgatagccgcatttcattgcttcttttaccgctgcaacagccatatctccgttttgtacctgccatgtgccgaagccaatacagggaaccttcacaccgcctgagagttcataacaatctgttaatgttttcactatattctccccctatttgcaatttgacaaaccattggtttgatagtatatttgtatcataaaccttaaccttagctctaagtcaatatagaaaattaaaaatttctgtaaaatgcaaaggtccgggaaaaatgaaaaacacccccaaaataaggggaggagggaatccagatgggttatacaatcaagcaggtatcggaacggacaaatctaagcgcgcatgtactgcgtttttacgaaaaagaaggtcttttgtcccatattaacagaagtaagagcggcattcgtaattattccgaagatgatctggaatggctgggtttgatctgctgtcttaaaaatacgggcatgtccctgaagcaaattaaagagtttatggatttaagcgcagaaggcggaaagactctgaaacagcgttgtgatatattgatcgaacacaaaaaaaatgtggaagatcaaattcaggagatgaacaaacatctggaaaaggtatcccataaaatcgaccattatacaagacagtataaagaatataagtgtaacgaagctcatcgtattgcgaaagcatgagaataataagttcatttgcgtaaacacaggtatgatgattgatttaattttacctatataaaaggttgcttgctaaaacaggagcaactttttgtattttacactctaaaagttcccatatatccattcctatccgttttcacccataactcaccttcatacataacaaagcatgctccattatcatttacaaaaagcgatactgttttataccatagtctatacaattacatttctgaataatatccctttacctgcaaataataaccctattaatattaaggagaacaattatgtctaaagattcacaacttgatccaaaatccattcgaaagaaaaaagccaatggcggtcccaccatggctgagagcgcattagacggagaaagccgaaataccaagaagcagtccggcagccgccacaaacccggcaacgataaataacaactttttatgcaaaggagcgattatatgaatcgtgatgagctcataaaccaagttaaaaacgaatatgcacgaatagcctcttctgaatcccagcagcattttcatcagaccacaaccgaaataacacctgaggcgtattatgaaaacctgttaagcaaagctatcagcgaaatcaacagaggaacctttgacaatttcaaatcgggagaggaaatagtgaccgctattgcaaatgacaaatcctggctttccgattggaagtaattttgaccccagatttatgacctttatcccagacccctaatgaaaaccgcagtcctttttacaagggaatgcggttttcatccaatttcagacccaattttcagtcaacattataattccagttccaatcaccatgataaatcatccgcttattcattcctccatccacggtaatggtctcccctgtaataaaatcctgtttacataaaaacagcaccatatccgaaatatcctttggatttcctacttttcccgccgggatcgcagaacagtcctcacggctgaattcctgctgcccggttacattgatccagcctggtgcaatgcagttaacaaggacatccggccccaaagatatggccagagcatgtgtcaatgcaacaattccgccttttgcacttgcatatgcctctgtatcaggctctgactgaaatgcacgtgaagaagcaatattaataattcttcctttatttttgattaattcatctttacataaacggcttaattcaaatggagcctttaatccgattgataatgtataatcatattcttcataggataaacctgacaaaatacctttatttccacggcaggcattgttgaccaggacatcaatccgcttaagcttttccatagaaaattcaataaatctttttaatgtcagcgggtctgcaacatctccgcaaaagtaaatcaaatttggattcccttctgcaaaatcagcggatttcctttcatctatatcaataaagcatacctgatcaccggcctccatgaaatccagacatatttgtctgcctatgccatgtgcgcctccggtaacaacaatccctctattcatgacagcctcctcagttttataatatcatattgaatataaagacaatataacattaaatccatcattcatgtcaaggttttcttttgtttcgatttattttaaagaatttaacccggagcagaaacaatgcactttatccgctgctgaatgcttcttaatcatcatcatcacaacttatacattgggcagaatatggattgtttttataatcatacttttcaattggtaccggccccctgactactgtcctgtgaacgcgcaattctccgttttctccggcagcaattctccagtcgaccatctgtatcttgccatcaacaatttcaatcccggaaagaccacgggtccgtatacaacagcctgtattaaagtatggaaggtcatctgctttcggaaatttaggcctgtgagtatgtccgcagataagcatcattttatgtttttctatccaccggcaataaaccttctccactttatgtcttttatataaattacgagccgggctggtgggattatcaaatccaacaatatgaaaatacctccaaaaataccgaagtaataacatggaaaaaaaccacaactgatcattcataaaatcaccctgatgaccgtgcagcaccaaaattttctgattcgtttttttatgcttaagaattacagcctcctttggcttcagccccctgaataaatccacgcgtatttgattgtattcatcataatattcataataattttctttgataaaccgctttgattttaaataaatattatgattgccgtataacataataaatcggcccgcatcatagaacttttttattacggtaaaaacatcgctgtgcgccaaacggatcacactaaaattcttatattcccaaagctcatctccatccccaacttcaatatattcatatccttctttataataataatttaatgcatgtaaaaaaacattctgattccttgtgaattcatctgagacgctgtcatccccctgtggacatcgctaaaaaatataatttttgaactgtcatcaaaatgtacagtatcagcattttgataagcacttgtcaaccgtctgtcagtcttcatgttacctccattaatgtcaaatttatataatcataaaagacagagtcaaaactttaataatcatccgtctttaaaatgttgcaggcaatattcattcaaggcataaacaagttgcagaaaaacttgtctatgcccttttatgatcggttcaaattaaggcagacttgacggaaggccggcaataaattcttgatccatggggactttgagcctgtttcataacagttctattccagagcaaaaacaacagcaatgcaatgagctaaacaataatccgatgggtttttccgtcatcctccagcataaccctgttcccctgaacaagcctgccatccacagtgaccgattctgttgtcagcattcccttgcttctgctttccaccctgatctcatagagagatttcccgaacttatattcaacggaaaagtccccgaagcttgcaggtgtcgccggatcaatgatcagctcattcccctctttcctgatacccagaaaccagtttaacagcccctgatacatccagcctccggaaccggtataccagctccagccgcctcttcctgtataaggaggactaagggatatatctgccgtcatcacatagggctctttttcgtacctgagcacatccttcctgttttgtgtcacgtgaatcgggttaagtatggtgaacagggtttgcgccatgggatagtcatgaagcatggaggaagcaatggccagccaggccgccgcatgggtatactggcctccgttttcccgtatgccgggaatataatttttgatataaccggggtttttacttgtcttattaaaaggcggcgccaaaagcagggaaatggcatcctgctcccttaccagatagtgataggcagactgcattgctgttttcgcccgttcctcttttgcccctttgatatcacgctccaggactggctgatggaatcgatccggcactcatcgttttcctttgagcccagctttgagccgtcgtcgtaaaaggcccgaagataccactctccatcccatgcgtgttcttcaatgctttgaagcagggtttcccgtttctgtttcagttccaggccgtaagcctcatctccctcctgatcgcacaaagggatgaagtcacccaatacagtatacaaaaaccaggccagccagacactttctcccttgcccatgattcccacctcattcataccgtcattccagtcgcctcctcccatgagaggaagtccatgctcaccaaaacaggtccggtcaatggtctttttacaatgttcataaacactgtcaaaatgctccgatacttccggagtaaacatgacatcatgctgatcctctttaagcaccggccccttaatgtaaggcaccttttcctttaaaattgtggtatctccggtgcttttcacataggcagcggtgcaataaggcagccacagcaaatcatcggtgattttcgttctcacaccgatccccatgggaggatgccaccagtgctggacatccccttcttcaaactgcctgctgcaggcaattaaaatttgcctgcgcaggatacttgaatccgtaaaaagaagggaaagggtatcctgaagctggtcccggtatccgtaagctcctccgcactgataaaaggcagctcttgcctgaatgcggcaggataccgtctgatagagcagccagccgttgaccagaatatccaccgccctgtccttggttttcacctgaattgtccctaataatccgtcccaataggatttcaccctgtcaagctccttttgagcagcagcagcctccctgtatttgtctctgattttgtatatttcttcaaggctggtgctctgccccagcccgaacaatattgtcctggtctcttccggctgtattgcaacggatacctgaattgctccgcaggaatcatagcatacacctgtattacaggatagcttaacttccgctccgtgaggttcccggatgctgcccttctgcccaaaaattcaaaaattcctgtctgtcgccggtataaccgacaatggtttcactggaaaacaggtaggaataggtgttttgaaagttcatggtataaatgttttttgcatataaacattcatgctcattgttataggtggtgagaatatagggattggtctgctctctctgggtgcccagaacccattccacataataggtcaggcttaaatatttcactttatccgagcggttggtcagttgaaggctccatagctttaaggactcatccaaaggggtaaagacagtcagctcctggtccaccatatcttcctcatgaagaaacctgctgtatccaaacccatgccttacccggtaaatccccttgtcagatcttccaagggacataggcgtcatcacctcaccggttatttcatccagaatatagattgcctcggaagctctgtcacttacagggtcattagaccagggcgtaagcttattttccctgctgttgatactccaggtaaagcctgcacccgactccgatatctggaatccaaagctcttatttgaaacaacattgatccagggcgccggcggtctgttatcaccctccagcagaatttcatattccctgcccccacaggcaaatgccccgaagccgttaaaaaattcgtaattctctgtttctttctcctgtgttgttggtgcatatgctgtgtccaaagctctttcctccttaaagcctaatattcttcaagtaattcatacagattttcttttccattggtaaaataaatccccgatttctctgagaatacaacccgtgctaccgtatacagcagatcaatctccgccggcttcatatcataggtgtgcagtgtaaaaaagcttggcttttcccttcccgaatcataaatccgcagagagcttgtcatatccctgatcaattcatccacttcctgaaggtagccatgtttggaatcgatcaggataattaaatccaccataacacggttgatccttaaatattcgtaagcctttaatacatcctttacgattctttcctcttttatggaccgaaccattaaaagcatgataggattatccccggacacgccgaatttccataaaaagctttgattcataaagttccgccttatattttcatccggccctctgtaaatgcccgcagggtagaagaccgggctgattaaatcctgaaaggcgttcagctgggtcctgttaatctccagatattttaactccagattggtttgaagcctgaatttctccaggatatcatcgatccggtaagttactttcagttcctcagcgatttttattgcttcctctttactgccgcacacaccggtaatgaaagaaatgcaggcagtttcacctgctcctatataaaactgtgccctcaggctcataatcggatcattacaaaagcctgaatgattgaaaaaggcaatgctgttcatcaccgtgtccggattctccagggtattgtttcttccgataaaatgctttctgtcattttcgtattccagttttttgcacagcttcaccccagttcttaccatatgcatcacataagaattatcatcctccttcttccgccgccttttggcgaggaagatctcctgctctttcacaaactcactttccagaaagagcttattaaatgcaggatggctgatctctgccagatgggtgtcatccaccacctccagatagctggtcacttccagctgtttttcctcattcccatgattggtgaatataaccttgcgcacctcaaagttatggtctgcatccaggctgacgatcatgtgcgatgaaatatccccgtccctgcgtttaaattccgcctggtgagggctgaaaatcacctggtactcctctggctctgtttttgtaggatgataagcagcgctccaaaccttcccctgcttcatgtccttgatatagatataattaccggtattcgcataaatatccgaccgccaccggtaaagcatacggtcctcatatttgctgaagccatccccatcggccgttaccatcagcgagtatttgccgtttgataaataattcacaaccggtggattcatgcctgtactgttgatataccggttactgtaaatgtcctctttaaaaagaggctttccaatctttattgtatatccctgctttgcaatggagatcaaataggactggcgtttttcttccagcaggacttccgaggcctttatcatcatctccccatggaaccgctcccgaaggattccctcattcatatgattgttgatggctgccagaatcatcccctgatgatgggccatataggattttacaatgcaatacggggtcagctccaaagaattgggcacgttaaaatcaacggactcatagaagccgtaattgccgtaagcgcctaattttttcagcctttttaaattgctcatgctttcctcttctgcaacatccagagccagcattgttgcatagggagcaaccacaagggaattcttacggaccggctggagtcttatctttggaacgccaaaggctttgtattggtaatttgagtttaaatcaaaacggtaatactgggattccgatatgccccagggtatttccgcctcctttgcatacttgatgtgctggagcaccgctgccctggaagtctccgagtagacagagccttcatattctttaaatacaagattcggcatcagatattcaaacatggttccgctccaggatacaaaacatggaattcccttaacaatggtaagaggtcttcccagcttataccaatgctttaacggcacttctcccatggctatggcaagaagacttgtcagtgccgattccgatgccattaaatcataacagccgtcatccagggtgtgggaggatacatgatatccaatatgaaacagcattcttttttcgttaaacaggaaacggaaatctacattttctaaaatgcagtctattttactgctgattgttttgatcctgtcaatcatgctgtctgcagatttgttttcctccgatgcaatacggctgaggaccggataagaagagatcttctcttccttgagctttaaagccgcagcctcatttacaatggtgtctatgagagccatcagctgtctggtccatggatagtctccaggcggcttaagctccattccatttaagttttcccagatatccgcaagatcttctaccagctgcccgatcctttgatacccggtcttaagcttatttagggcaggattgcctgttctcctctgtatttccttattgctgttctcaattgcgattctaagttcagaaagaaaattgtccggataaaccggcttgttgatctgatctaaaaggccgttttttaaagtaactaaatgccccaggaaattgccgctgtccacggttgatatataggcagggttcagcacctccagggttttaatgtgataccagttataaagatgcccgttccatttgggcattttctgaactgtttccatcaggttttccacggcttcaaccgtagagctgagagtctccaatccaagatccctggctgaaagaattgccagaaactgaagtcccatattggtgggcgaggttttatcgctgactttctcaaccactgaaatctgataattatccggacaaagccagttattttcctttgtggagagctccttaaaaaactgccaggttctgcgtgcagtatccagaagcagctcattatcctgagtcttatctcttaaatgaagcttctcctccggctggctgatccggtatgcaatttcaaaggaaaaaaaccagtcagcaattaccattgccgtcagaatcactcctgccaggttcaaataccccatgaataaaataatcccaagcacgaatgccggaagaagagaactccacatggtaagaaaatatcctcttcttgtattgacaatggatgcatccactgactccgccgtattccagcgaagcagattttttttgctgacaaagatccggtacagggttctgacaatcgcatcggctgctacataagcacggtaaggagtgattgtaaactccagaaatgccctgtaaatcatcgcagcaagctcctttaagaagcctttataaacaagggcaagcttgggccggaacagtttctgggtaattaccgccagcaataggatcacaaggctgaacatatcattaaagaaaacaaggagtaaccaaagattatatgcttttggcatccatgccagattcagcaatacaaacagagttttgcttaaaggaaccaggcttcttcttaaattgtcaaagattttccatcttgataatgcacaaaggcttttcccatccctggttttcttcataaacagccagggcagcagctgccagtcccctcgcagccaccggtgttctcttttggtaaaggacaacacactgctgggaaagttgtccatgatcttgactgtgctggaaaaagccgtccgcgcatagcagctctcaaaaaggtcatggctgagaatccggttttccggcaccttattctgaagcaccttgtggaaggccttcaaatcataaatacccttccctgtataaattcctttgttgaaaatatcctgataaatatctgatattacggttccataatgggcaaggcctgattctcctccaaaaattttcgtaaacctgctgccggtcttatccgcaatatggtttctcaccgagggctgtatgatgacatatccctcctccaccctttggcctgccggatccagaaccggtttgtttaaaggatgatcaatcagccccaccagtttcgaggcattgtcacggagcagatttgtatccgcatccagtgtaatcacatattggaaggtggtaagaagcctttcgtcacagtaaatagaggaaaaggtggtatcctcctttcccgctccatttaaaagactgttaaattcctccagctttcctctcttacgctcccatcccatatagcagttctccgccttattccatttgcggcagcggaagaacagggaaaaacgctgctcctccgacggatagagctcattcaattccttcattcgctggacaagggcgttttcgatcacctggtcctttgccatgagctggtccggcgaatcctcaaaatcaaggagcaatgcaaaaaaaggtttggctgccggtttgccagataatgcttttgaaggcgttccatgtatcccaggccttgttccttagaggagacgataaccggcatgatcacaaaggttcttgcttcctttggtatttcctgtaaatagttcagggaaggaatcttcctgaccacaattcttctggtaaatataaaattcgtaatttcaatggcaacaccgatcagcagcggcaatgcggccaaaaggattatcacataccggctgacagcctgcagcccgccaagggtccggaacgcataagccaaacatgcactcagccccaaaacaatgaggaacagggtaaagaaataaaggaggccatttacgttcacccgtttcttaatatgttcagggaccggcttccccaatgcttttgctttcaggaccggataccccttacctaaaaggtaggttcccacatgatgggaacaatggagatcctctcttccctgaaccgccagttccaggcagtcctttgctatcttttcctccagcagccggtagcggagcgacaatttaacaatgatcccgcggtacatgcccctggattccatatccatcttggaataaacgtcatccggatcctgtgacaaaatctgctcaagacaagaatattcctcaaaaaaggtttcctcgtccacctcattgatatctcttaagctgacaattaaagtccgtatatttgtctcaagaaatgattcaatccttccttcctccatgaatatgccggaggtttttacctgtctttccacggaagaaaaatgatgttccagatatctttgagtggaagcctcatcaaatgacatatttttcagcaggtatatgacgtgggcatggaacgagtagttcagccttaagctatcctctattttgcaaagcagtgccgatatatcagccggcccctgtttatcagccagcttatcccggagaaacttttctgctcttgacttcacatcaatcatacgtaggatctcttctgcgatcacaataatttcttcaaggaggcaaaaacccagcacttccggtaaaacccagatttccttatccgtaaggggtatcttctgctgataggcattcagcattatggaaatattttcttcgcttaagtgtccgccggagagagacaccatcttttttgctacaacataaatacggggaaagttacggtattcctttcccttcagtaccggcaatacagcatagctggttcccgaggtacgcactctcttaatttcccggtacagcatctggaaattatcaaagagccagcgcgctgccggaatcagggaaatgatatccgtagatgcagcggagatgctgtctcttattttattcagttttttataggcagcctgattataatcattaaggacaaagctgcgtcccaccagtctgacctggctgtggccttctgccagatcaagcatttgcttctcccactcgctgggccccggtttattatcttcttcctggaaacaggccggaaaacgcgccttcttattaaagtgatacagccggtaatactggataaacagtgcagaacaaatcaataccgccagtatcaataaaatgtacagcaaaaacggagaatttatataaaaattaattttttccaacaagctttccaattgaagctcctccttatttaagaaatccctcatacatgccaacatccttttacagatagtttgtctgtttttccgtaaaaaatagcgcaatattatattgtagcactttttacgtttttttattaatttcctgtcagatttataaaatttatatgaactttgtgtttctgcgggcaattgagtttttgagatttattatggtcaggagttacggaatatatatgtgattttaataaaacgacggttagaaagtcagattgcaggaaatgtggatcattgagaaatggcgggcatttgaacatgacgatcctatgaaggtgataatcattggaaattgataattatcatgcacagatagcagaaagagcatccctatccaatgagggatgccctttgaaccggcgacaaacaggctgccggaagcagcaattgttctgacagcaaagttatcagccaattaattccttatcgttcatgagctgttctcttttgttatccaaaatcccaactcctttacagtgttttcgaacgagtgatatcattccctatcccttttacaacacccccaatatcataagctttagaaggcaaaataatagaatgctctcccagtatttctttcattattctcaattctaaatccctacgtctcctaaaatgagcaatcatgtgagacatatccacaaactcacatttctttccatagggtgaagcatttaaatatttcatcatgaggggaaaccacatctccacaccattttcatcggcccgttcttttttgatccttagaacatcgccttcgatattatcagaacagagatagagcaatttaaaacttttttgcttgataactgtaaatagttctctgtaaaaatcaagaatttcttcttctgatttacaataatacagcatcaactcctcaattatgttttgaaagaatgaacattcaaacagattgcctgtaccatgaaagttttctaagcggctaaaaatcacatttttaaattcatcaaaggaacgccttccgccatatatttcatactgctccatatattgatgaaacccctttacatcagtaatgatccgcgtatacgccgtgataaagtgactttcttcttttaccgtatacttttctatttctggtgccagatcaggaaatgccgcaagagcctgttgatattcttcctctgtcatgtaactgcaccatgacagttctaccggcgaaatatctccttccagatacatgtgatatccatttagtttctcatgtagtgatctcattaatgtggttttgccagaaccctgcattccctctataaatatatttgtcatctgattctccagttctgccggctttatgtatgcatttttcctcagcagcctattgctcttccattaccgaaattcttttaaacatgcggtcagttatatcttttctaaaacttccacagttctttcgtttttaatatttccagtattcaatgttgtcttgggttcaaggagcattacatggacttcctcctcagcaacaggcatgtgttcaattccccttggaataataaaaaattccccttcgtttagaataatatcttctgtgcgcagcttaatcaacaatcttcccctgataaccatgaacatttcatcttcattctcatgcatatgccatacaaattcgcctttcagctttgccagctttacataggattcattgatatcaccaacgattttgggactccagtattcactaaacgcattcagcttttcattgatattaactttttccattctgtttacctccaggtttcgcattaataatccttttcccgccatttaaaacaacttattccagccttccaaaaacaaaaaaccattattatttataaattttcttcctgtttagcgattaacaggctcatattctatatgtgacttctcctccatggcttccagcttaaatataactggccttaatccatcattgcagctgcaaatcgcaacacccggttcacgaatccaaccgccgtaataaaatacatcgttccctctttcccattcccggatattaaagttaaaatttgttaaaatggagtttttgatatggcagcgcattttcttcatatggctttttgtcctccgcaggataaccaacggcaaccatacattccacactatattgttcagggatctccagcacttttttaatgtattcccctgctgtctcttgctttgtatgaaatctttctcttacctgaatccagcatgaccccagttctaaatcttgtgccatcaattgaattatggttgccgatatggaagcatcttcaatccacacatcgctggaaccgttatccgctattactactattgctaatggtgcacctgctaaaaactgagaaccaggttctctgcacagagagagctgccgaatcagttctgcatcggtgacggcaacaaactgccaaggtcttattgatcgcgatgacggggctaacagggcacttttaagaattacatcgatcttctccttttcaacttccttattttgaaactttctgatacttctcctggtttttaaaatatcaaataacataaattactcctttctgaactttatacgtttatagttctttaaaaacaatagatttctttgaagctaatgtctttcccatctgattcataaccatttcataataacggccctgctccttcattaaactttggtgatctccgctttccaggatctgtccgtcaccaattaccataatgtggtccgcgtcccggattgttgaaaggcgatgggcaatcaaaaagcttgtgcggttctgcatgagactgaccaaagctttctgtatctctttctcagtttttgtatcaacgctgcttgttgcttcgtcaaggattaaaatcggactgtcacagagaactgctcttgcaatggatatcagctgtctctgtccctggctcaaattatcagtggctgcggagatatttgtagaatatcctttgggaagtttactgatgaagtcgtgggcacgggcaattttcgccgctttgatcacctcttcctctgcagcgtcatttttcgcataacggatattatccatgatcgttccgctgaacaggctggtatcctgaagcacaacggagaagcattttcttaagctgtcccgtttgatatgggtgaggggtatcttgtcaatcataatttcaccgctgtccgcatcataaaaccgggttaacagattgacgattgtggtttttcctgcccctgtttctccgactaatgcaatgacctcacctggatttacatgaaagcttacgtttttaagaatcggtttttccttatcataagaaaagcaaacattatgaaaagaaacctctcctatgggatgccggacttcaattgcgtctatttgatcttttgcttcttcctcgtgatccaatatttcaaaaacccgctcggctccggccagtgcagattgtattgtgttaaacatgcctgccactgaattcagcggttgtgcaaattgctttgaatagcttaaaaagctcacaaccgtacctactttcaggccatggcttacggataagataccgcctaagatggcaacaacagcaaatacaaaattattaatgacattcattaagggcatcatataaccagaccagacctgcgctttattgctgctttcacataaacgatcgttgatttccttaaactgccaaataacctcctcttgtctgtcaaaggccttcaccatttttaaaccaagaatattctcttcaatgacaccgttaagtgctccaagacttctctgctgtgccaaaaagtaagcacggcttttggaagcaatcatcttggtcaataaggaaaccagcggcacacacagcaaaaccgtaaaggtaagcggcagattcagacgaagcatgacggccagagaacccacaagcgttaagatactggagatcagctgcgtcgttgtctgcgctatggtggaactgatattatccacgtcattggtaattctgctcatggtatctccatgagaccgtgtatcataaaaatccagaggaagcttctgcatcttcccaaaaaattcagtacgaagcgtaaaaaccagcttttgggagatccgcagcattatgacaccgtttattaattgaagcagccaattgaccagatataaactgaatatgatgatcagaagcgaaaccagtctttgggagtccacgctcctattggcagtatcaaaggtattgaataccttacccacataatacggaattgcaaccgatatcatagaagaaataactgttaaaaaaattgcagcaaatatagtcttagcccaccgcatatagatttttacaatccggattaacgttccttttgcattcttaggttttgcagtcggagcaaaacgatcccttccggcgcccagacggcgccccatggccggcacttttggctgctgctgactgaatttttctgccatatgttatgcctccctgccgctttcaatctgtgtatgatagatatcctgataaacttcacaagactccattaattcctcatgtgtaccaaatcccacgttccttccattctccataaccagaattttatccgcagacatggctgttccacagcgctgtgtgatcataatgaccgtctggctgaactctttatttttaaggttttcccgtacctttgcttcggtgacggcatccagtgcactggttgcgtcatctaaaatcaataccggagcttttttcagcatccccctggcgattgaaaggcgctgcttttgtcctcctgacagattaactccgccgcttccaagaagactgtcatacccatcaggcatctgcataacaaagtctgcctgtgctctttcagctgcctgccgcagttcctcaatagcggcggatttatctccccatctgaggttttccgctactgatcctgaaaacagcattggtttctgaggaacgatcgccacattgcttcggacctcatctgcgcccagcatttttatatcgtaattgtccagaattatctttcccctgtccacatcataaaaacgaaggagcagccaggtaattgttgatttgccgctcccggttgggccgattatcgcaaggctttccccgctgtttacggtgaaagaaagttctttgattgccggaactccacttccgccgggataggcaaaggtgacattttcaaaggtgatttttccactgagttttctgtctttgttacttcttaaacaatcttcttcacagtcaaatacttcacggatccgggctgtagaagctttagtacgaacaaagacagtaaatacatttgttatcataatgagagaagtaagtatttgcgccatatagatcgtaaacgccgtaatatctcccgtatttgccagattcagggcaaatagcctgcttccaatgaaaatcacaattaccgtaccgattcctacaactaaggtcagaaaaggcgagatcactgtgatgaccatttgggaggatattcccttttgcattaaatttgagtttgctttttcaaatttatctgtttccctttcataagtaccaaatgctttgaccagccggacaccgatcaaatattcctgtacctttgaattaacctgatccatagccttttgcagttgataaaatcttgaatagctgattttcatactgatataaattaatatggtaacagcggctactactccataaataacaaggctgagccggaagttgagcaggcttgccattacaatactgccgatacaggtaatgggagacttaaggaaaatacgcatgattccatttacaaactgtatgatctgagaagtatcatttgtcattctggttatgagtgaaccgctttcaaccttatccacacttacttccgaaaaggacatgattttctcaaataagtccgcccgtaaatccgcgcccattttttgagaaacctggcttgacagaatatttcgtgaaacagcaaagcaagcgcctgccagagttacaatgagcatcagcatcccccagtaataaacctttgccagagagcctttttcaattccgctgttcacgatgcgggacatcagtgtggggcccagcaaatcgcagaccgcttccagcgtcacacacacaactgctataaaaaacggcactttgtatcttctgaaatatttaccatatagcttcattatttgtccctgcttccgttatgatcttattcctgcaatgattgatagacgtaataaaataagtatatcactcaaagcgcagaaatgaacaatttctaaagatttcttttacatttctggtatcaatcagcaagccgcagcgattggtgcggtttgacgctttgttgatctggctttaagaagcatagaactttataaccttattatattccttcataatactttgtaaaatatctacatgcttaaaatcactgtgatatagaatattaatttcccgaatcatgctgagattttcaattggcagtacagtgatcttccctttcttcagttcatcaagacacacgcttcgggaaagtatagaaacgcctatatcccgtcttataagatctttaatcgtggcaatattatcaacctctaaaatgacattcagatcatcaagtgagatgttattgctttctaagtgggcagtaaacaggtttcttgtccctgatgacggcctgcgaagaattaatggctcctcttttaattcgtttatggtcaccatgctcttttttgctaaaggattattgtttgataccaccagcattaaagaatctgtatcaagaagaagcgagttaatgctggcatcttgaaccttcccctcaacaacagctatatctacctcataatttctaagcatatcataaagattatttatggagtcagaaataattgttatgcttgtgcctggacttttggagctgtactttcctaatacttcagccacagcattgctttccgcagtatgagtaattccaaccgtaagccgtcttatatggcgctgttcatccaaaatactttgttccatcctctgatataaggcgatgcttcgccgggcatactgaattacgatattcccttcatttgtgggctttatctcgcttccggcacggttaaagatcttaatattcaattctttttccaattgttttatgtgttgagttacggctggctgtgtcaaagacaaatgttctgccgcacgtgtgtaactgttaaattccaccactgccaataaggtgtagagtttagcatcaaccatttagtccatctccaattataagtatttattattatatattaaaatattataaatttacattataaaatttatgactataatgatagcataagtcagaaagggaggcaaggataatgaggctaaaacttttatttgtatggcacattctaatttttaatgtaataaaaccgctgccatattcttctgactattttaataatcactttcggacaacaatacaaaattctgctgattgtgattcactatcccgctacgtagaaattgttaaattcggaatgaagcattcaggttggtctggaatagtcttggccaatattgcactcatgtttttctgtttaccactttgtttttcagcggatttagtaattcatgccgcacacctgctttcgataaaaataacagtcaatgctgttcttgttctgatgatgctggaaaagttcgatatgcttcgttttcgcgacaggcgaaattatttaaaactactttatctttttatttgtcttgtctcatcatcatattggactttaacatgcgtgttcttatccgcatttgaaaatttaatgttataaaggagtgttaatcaatgggtaatcttttaaatcattcaaatgacacaacaattgttctttcatctttgtcagtaattttactttccggatttctgttcacccgtattacaaaactggctaagctgccgaatgtaactggctatattgtggccggtgtcctgatagggccatatattttgaatttgattccacatgaaatggttgaaaatatgggctttatcagcgacattgctttagcctttatcgcatttggtgtgggacgtttttttaaaaaagaggcttttaaagaaaccggaatgggcgttattgttattactttatcggaagctttactggccggaatattcgtaactttgtccgtgcactacatattccatttaaactggggcttttgtctgcttttgggagcgattgcaacggcaacagcacctgcaagcactatggttaccattcggcaatatcatgcacgtggaaattttgtgaatactttactgcaggtagttgcacttgatgatgctgtgtgccttattgctttcagcttagcttctgcttatgtcagtgctaatgttggtgaaaatatttctgtttcagaaattaccatgcctatcgtttataatattggtgctttggtaattggttttataagcggtgctatacttagcaagctaatgactcctaaacggagcgaggataaccggttgatattaacgatctcacttcttcttggaattgcgggtctatgttccgcggcagatatttcacccctgctttcttgtatgctttttggcgccacctatatcaatatgacgaaagacaaggaattatacaagcaagttgaacggtttactccgcctatattatcaatattctttgttgtatcagggatgagtttagatatcagctcgttcagtactctgggggtgatcggcgtaacttattttgtaattcgaattgcaggaaaatatcttggcgcttatttgggttgtatgatggctaaaacaccaaaagctatacgaaactatttaggattagccctgatccctcaagccggggtcgcaattggccttgcatttctgggcagaagggtattacccgacagtatgggaaatatgctgctgacaatcatattatcttcctcggtattgtatgaattaatcgggccagcctgtgctaaaattgctttgatctattctggctcaataaaaaaagataagctttcagctcataggaaaaaatcgaaccggcagctgagagcgcgccagaggaccaaaatactataaaaataagttcgtgattccataattaaacatagaatcttatcgcgctgtaaatcaggccgggaccatgggtgctgccggcatctgctgttttgtacccaggcccagatggcctcatacatataaattttatagaatcaaatgtacatatggaaataatccgttataatataataaggaaaattgaaaggagcatcactatgcatacagcagattattttattaagaacctgaacatgacagcacatccggaaggtgggttttataaagaaatttatgcgtcagaagaaagtataacatcaaaagagttaaaagttgactttgaaggttcacgaatactttggacaagcatctattttttactcagagacggagaagtatctaatttccacagactaaaatcagatgaaatgtggtactatcattcgggttctcccctgactatttatatgatcagcccaaagggagagtttttcaccgaacagcttggacttgatattgaaaatggtgaaaagcctcaggtattggtgccaaaggattatatatttggttccgctatgaataacaagggatatgcattagtgggctgcatggtatcgccaggatttgaatttaaagacttcgagctattcaaaagaagtgatttaatagaaaaataccctcagcatcagcagatcattcacaaactgacttccaatgaataaatgttaaaggccttccagtcacatagttgttattggaaggcctttaaagggcacatatcagttactcagcagcaggttctcatgtttggcagtcaaattcccgcaagtccattggaatggaaacgatcaagcagataacagattgattcatagggacgcaaggaaatagaacgggtcatttcaggagaatcttcatagttggatattaaaactttcgattcacagccattgatatttatttcttccggtaacaggaattgggtattttctccgtaaaagttatttaaaacgatcaatctctgctcctcaaggctccgcatgtatgcatatacttttggatgctcaatggataacgtttcatagtttccataagcaataatgtcatgctgtttacgaagcttaataagcttcttatagtggtaaaacacagaatccttatcacggagagcattttccgcgttgactgaccgatagctttctcccacggacagccatggagttcctgttgtaaaaccgccatgttccttatccttccattgcatgggtgtacgagagttatctctggattttacgcttaagatccttaacacttcttcttttggtactccctgagcacataaaatatcataataatttaagctttccacatctttatactgttcaacggaatcaaagtaagggtttgtcattccaatctcctcgccctgataaatataaggggttcctctgagcatatgaatggctgtggcaagcatttttgcagattgcttgtggtattccctgtcattcccgattcgcgaaacaatacggggctgatcgtgattgcaccaaaacactgcattccagccattgccttctgtcattccattttgccataaatcgaagatgtttttcagctcttcaaaatcaaaatcctttaacgaccatttttctccatccttataatcgatttttaaatggtggaaattaaacaccattgataattcttgttcctctggattggagtagcggatacaatggtctatggttgttgatgacatttctcccactgtaataatatcatcatattttccaaatgtttctctgttcaattcctttaaaaattcatgaatccttggaccgtccgtgtaaaaacgccttccatctcccatatgatcgtccttccaatcatcaggcttggaaatcaggttaatgacatccaggcggaatcctttgatgcctttattaatccagaagtttacaacatcaaaaatttctttccttacttcttgattctcccagtttaagtctggctgagttttgtcaaacagatgaaggtaatattcatcggttccttcaacaggctcccaaacagacccgccgaatttagatttccagttggttggtactttaccgccttcactctttttaaaaatatagtagtcccggtatttcttctctcctacaattgcttttttaaaccacgcatgttcagaagatgtatgattaaataccatatcaagcataatatccatatttctttccctggcggcagctaccatttcttcaaaatcatccattgtcccgaaagcaggatctatattcccataatccgcaacatcatagccgttatcattttgcggtgacacatagaatggggtgagccaaatgtaatccacacccagttcctgcaaataatctaatttttcggttacaccctttaaatctccaaatccatccccgtttgaatccttaaatgattttggatagatttgatacacaacgctttttttgaaatctatcatgattgaactcctcccccttccggatgcagttcataatacttcttttttccggggtatgccctgccctcttctatctctttctcccatctttttgatccggtaccaatgaccgggccttttaaaaggggatcctttgtctgaaccatccagttctctactttctttctgaattcagaggcaatatgctgataatccggatgattgatcacgttgttttcctctaaaggatctttttgtaaatcgtacaattcttcttcttcatttggaacataatatttatctctggtatcaacgccggataagcttaaatgggaatctatgggcaagtacactttcggaccatctgcgaagtttttcacataactgaattccctggttcttaatcctctcattgggtggtaccgatcatgccaggtcagttctgaaaagaacgattctcttccggtatcctcatttgatttcaacaaatgagcaaagctttttccatcgagattatcaggaatttctgctccgatcaagtccagaaccgttggcagcagatcaacgttacacagcaatgcctctttttgagcgttcttttgtttgccgtcaggcaaaacaacgattaatgcggtttccaatcctgcattctttaaagttccttttgctcccggaaaatccactccatgatctgttgtaagaataacaatggtgtttttatctaatcctgtttctgacaatgtatgattgatctttccaatggcagcatctaagaccttagcagaaccgttaaatagtgtaatatcttctcttacattaggcgtatccggcagaaagtcaaacaccttaacttcttcccgtttgtctgcatatggtgcatactcgtcaaagctcctgtgagtttcaaaaaaaccgacatttaggtaaaatggctgttcttgatttcccttatgcctttctaagaacgtaatcacttcttctgcaactctcggagctctgtcacctggaacaggaataaagttgtcataccctaagtcataggttgaagagaaaacccgctcttcaatgggcggagcaacgttgatcgtttcatggcttaatccaatcaatgtggtttcatatccgttcttctgcaattctttaggcaaggttgtatgacttccgtcaatgcagaaacctaagtgagccagccccatcattccgttattatggggatacagacctgttaaaatgctggctctgctgggactgcactgcggcgctgtgcagaagtattgattaaattgaatcccctcttctgacatctgctgaatcgcaggagtatctactttatatccgtagctgctaaatttccttccgctgtcatgagaaatcatcaacagaatatttggtctcattgtaatctcctccactatcttttttctttgctgaaactgaaacatttttattctcaaaggcatttgctcgaaatttgactagacaaatgttacatagtaattatattcactattcataaaaaatgcaatacttttatgagaagaagaaaacaatcaaataaagtacagataaatacatgtttttttaaagtataccttgacatgcatgattcaatcatgttaaattatatttataatttgtctagtcaaatttaaaagggcatacgattaaggaggaggtagtttctatggatttaaacgagcaggtcaaacaaattataaatgctgtcggcggacttcccaatataacatccgcaacgcattgtgtcacccggttaagatttattttaaaagatgaaaaagcggttgatacaaaagaattggaaaaaatagaaattgtaaaaggcagcttttcagccaatggacaatttcaagtcattgtcgggccgggattggttaacaaagcatatgctgcgcttatcaaggaaacagggttaaaggaagccagtaaggaagaagtaaaacaggaaagcaataaaaagttacatcctgttcaaagaggtgtaaaggtccttgctgatatcttcatcccgattttaccagccattgttgccgccggcatattgatgggattgaacaatcttcttgccaatccgggaatcttttatgaacagcccgttttagaagttcatcctggctgggccggcatttctaatatgataaacgtcatcgccagcacatcattttcatttttacctgcattagttggctggtcagcagttaaaaagtttggcggaaatccggttttaggtattgtacttggacttatcttaataaatcccgcattgatgccaggtgcacaatatgcaaggacacctgaggaggttcagtattggaatatcttagggctgaacattgcgaaaatcggatatcaagggcaggttatacctattttattctcatctttccttttagcaaaaactgagcagtttttatccaagagaataccggatatggtccagctgatttttgttgctcctttgacactgttaatcaccggattctttacttttacaattattggacctgtaacaatgtggtttgcaaacttaatcacaaacggagttgtcggtttatttgatatttctcctgtaatagccggagtaatattcggagctatcgtatctccccttgttgttaccggaatgcatcatttattcttaggagttaatttacaaatgattggggctcttggttatgcaacactttggccaatccaggtaatggcaagtctcggacagggtgccgcagctttggcaatattcttcatctgtaaaaacaaaaaaatgaaaggcgttgcagtatcagccgctatttctgcatggttgggaattacagaacctgctattttcggggtgaatttacgttaccgtttcccatttattgcttcaatgattggtgccggagttgcaggaggaattgtttcatttgcaggtgttaaagccggatcaattggaatttccggattacctgccttcctttctgtctttacggaatattggggcgtatatttcctggcaatgggaacttccattgcgatcacggttgttcttactcttgtattttctaaaatgaaaatttttgaaaagcaattacaagaggaataattttatacttaacatatgaaatgaggctatgaaaaattaattgttttttcatagcctcatttcatttaaaaatctattaaattttttcttcttgcgaaatcaacaaaccgaaatgtatccacacgctgccttgcttcatggtattgaaaaaatctcgtatcttctaaataaacttcacttctaataaccgccacatgcgtgtcattatgaatatccagcagtattttatcttcctctgtcacaggttcaatggtaatttctttgttggcatacccaatattcagacccagatcatgttcaatataattgtagatagaaagctgtgccgctgatgatggaatctcaggaataatttcagctattaagtaatccttatctaagataattgcttctccatttatttttctcagtctctcaagagaaagcacttccgttcttttacttaaatcaagcttcttagctaattctcctgaaattctttctcttttatttttcaaaatggctgtttcactttttaaatgctgctttttttgcatttcattaaaactgaccagaccagagccggcgaatttaagtttattaatatcaagaacgatagccccgcggccctgctttttctgaataaggccattttccatcaaaagtgcctgagcctttctcaccgtttctctggaaacatgatatttttcaaccaacttcatctcaacaggtaaaaaatctcccggcaaatatttcttttcttttatatcctttactaagtccaagtatatatcataatatttattcaaagaaatcactctcactttttattctgctgttcttattatagcaaagatatacttgactgttcaatactattctccagtattttgcctatataaggaataaaaggtttttaatcatgctcaatcagagtatatgccgtacagacatacttccatatacttttaattttaggttaataaagttttcatcgcttcggggatcttaccaggaccttctattctgcatagcttcccataacctctttataggtttccggagtaacaacaattgcatctaccgcaatctccttttctacctcttttccatttataaggtccaacagtaccttaacggatcctgcacctactgattcggccgagaaatatgcggaagcttttacacaggttccttccgctcccttattattccattcgtctttggacatataggcgccaagccctactacgcatgcctccccatcaagcccggcgctttccagtgcacgtgccgcaccaatacagccttcctcatttgcacctgttacaatccactttttaatctgtggattcgcagtaatgacggcggcggcggccgtattccctttatcagtggttccatcgtaatccgctttgaaaatattaccggtattaaaatccggaactaattctgtgaatttatccagttcgccttctgctctgggcacgcaactggatacagtatccatagtcataatcagaagtccggcttccccatcggaagaaagattattatcctttacgtatttccccagccattctccatttgcttcaccaattttataagcattgattccaacccatggagcaagtttttcaccggcagcatcctgaagggcatcatctgcggcaacaattggaatgcctgctgcctgtaccttgtctatgactgcctgggacatggtttgatccgggatgcaggttacaataccggaagcattgtttgcaattgcgttatcaatggcctttaaatattcttctggattcattttagcatcaacatagataaactctccgccggccgcttccactgctttttttgcagcttccccttcatcaataaaccaggtctgatctcctgctttataaataccataaacaactaatttttcttcctcctgagtctttttttctccgcctgtttccgtctgcgttgtctcccctgtgctgcatccaactaacattgcccctgctatggccgcacataacaatacacttaacagcttttttttcatcttttattcctcctctaagaattttatatccatccacattctcatgtgaaatgttaccgaagcctgtatgtatccatactcctggtattataccgggtgtttctatgatgcacttttcatgcttgccgctaataactccttttcccgccgttcctttctgatgtaatccgatgccaaagcaaacagcaataaagctccacgggctacatactgccagaaactgggcacattaaccataataagtcctgtattaaatgcctgaatcaaaatgactcccaacacggtcccgcccatactgcccacaccgcctaaaaaagagactccgcctaatataacagccgttatggcatcaaactccaggttgatattggctgacggctggcctgaattcattcttgcggaaaatatgattcctcctaaagatgtaagcaaaccgataataataaagcaaagagtattcattctctgtggatttaatcctgccaatcttgctgcttccgtgctgccgccaattgcataaatgctgcgtccgaatcttgtttttgatagaatgaacccaaaaattacaaaagaaaggatcatacaccagactgccagcggaatattgaggattctcagttttcctaaaaggataaaggatttgttgcttatagcaaccggctttccattgcagatgatataggcaaaccctctcacaattgcctgggtcaccagggtggcgataaacgcctccagcttgattttattcaccatccaggcattgaacagtcccactgcagccccgctgcataaggtgagcaaaattgcaacgggcagcggcataccccagttcagcaataaggccacaacaaccccggaaaaagctgccagggagcctggagacaaatcattctgccctgcaataatcagataggtatgaccgaccgctaccatcccaaccagtgaggcggcaaccaatagattaatcatgttctgcatgcttaaaaaattggggtttaaggatgtaaacagtataaatactacaacgatcgcagcagacaaaactaatttatcctctccgattccattcataatccgttttgcagcgccatctttcatctgttttatctttctctcatttttgttcattatcttattctcctatcattcccaatcttaataattcatcttccgttgcttcttcccgactgacttctcctgatatccgcaaggatttcattacaataatccgatcggaaagaccaattacttcgggtaattctgaggatattaagataactccaaacccttgctttgcgaattcacagatcatatgatagaattcagactttgcccctacgtcaattcctttggtgggctcatccaggatcagtactttgggatttgttacaatccacctggcaacaatgcatttttgctgattacccccggataattccacaattttcttatccggtgaaggagtctttatccgaaaatcctttatgcttttttctactttttctttctctttctttgtatcaattacaccgaacctgttagaatttttatccaataaggatatattcacattgcctgaaacacttaagttggataagatcccttgcagtttacggtcttccggcacaagaacaattccgttttctaccgcctcctttggggaatggttggtaatcttctttccttccagataaatttctccggtccgaagcttatctgcccctataatcgcccgcattaattctgtcctgccggccccaactaatccggaaaaccccagtacctcaccttttcgcaaagtaaaggaagcctttttcacataatcggaggaaacatcttttatttctaaaagaacatcccctatttgcttattcctgtccagacttttgaaaatatcacccaggtcacggccgaccatcatcttgatcagctttttttcctcaatttctttggttattaccgtgtccacataccggccatccttgaaaattgccaccttatccgcaatccgctgtatttcactcattcgatgagaaacataaataataatttttccttgctcttttagcttttctatgatacgaaacaggctctcaatttcagaatcacttaaactggctgttggctcatcaaaacaaatgaccttcaaattttctctgctgtaagccttcatgatttcaaccatctgctgataggcaatgcttaaatcctttaccttagcagcgggggcaatcggcaaaccaaattcatcaatgattttttgtgtcattttattggctttggctgtatcaatcacccccagccggttggccggcattcttcccagaaaaatattctctgatacacttaactccagcaatatctgcctttcctgataaatgacactgattccctcctgaattgcttcatgaggcgtgttaaaatgcttctggaccccgtcaagcaggtactctccctctgttggctgataatctccatttaacacctttaacaatgtggattttccagctccgttttctcccaggaatgccagaacctctcccccaaatgattggaagcatatctgatccagtgccttcacacctggaaaatattttgaaatatttttaaactcaagtacatggcccatgtgtattttctcctcacccaatgtcaaaccattatgaccgtttcatgatcagcacttatttctgttaagttccttaagcaagtcatgtgttatacaaatcaaataaaataatttcatgtttttcaattttctatagacattatatcaatgattccaatgattctctttaactcacaggaactttatatgattttttgtgtatttttcggaactgattgataataactttacacaaaaaaacaagggagaatgtaccatgatcgattctcccttgtctttttctttccgggctgtagtcacaaataaaagattctaataagcgccgccgcattcttgatcccatatacacccttctcccaattgaaggcctgtgacaaaaacattccttttaaaattcatccgcaatttttcctctccacatttctctgtaatcagccggtgtcataccggcatatttgcgaaatacacggctgaaatactgggaactgctaaatcccgtctgcatggctatgtcagtaatacttttactgctgttccaaagcagttctttggcctttgctatgcggagcatggtgatatatgttgtgcaattcatgccaagatatttattgcagtactttcggatatatctgtcgctgacatggtatttcctggaaatctcctccacattgagttcttcctctatgtgatcattgatataccgtatcactttccccaccaccccatgtaattccgaatcttcctcttccttcattttaatatactgctccgaaaacaccacgtacatctgagccaaagccagctccaattgtgcgcttgtatattcattttcttccgtctgttcccggaatattctgctcacattttccagggctttacacaaattctcacaagacaccacttttgtgtaaatccccgtctgatccaataccggaatttttccctcaagctctttgggtacggttacggaatactccaactgagttatgcagcatgcattgctcatgtcaaccataaaagaatgtcttacataaggattaataataatacaatcccctgcttttaagggaacatactcattatgtatcttcatgacgcagcagcctacgtttatgtagttgatctcatattcctggtgcttatgcatctcaaatctataacttttttggaacttgtatttaccggcttttcttattgccactttatactcttcattgtttaataatgtacaaatgcttttcatgatttcctgcatatgatatctcctttgattcccttcgtaaaaaacaaccaaaatgcagcagagcaatattcggtatcatgatatcataaccagtcagatatagcaattccagttgtttacataatcccaaacttgtcaaaggattcttttgctcccattccgccttttatcgcctctgccaccatcttctccccagtagctttttcatatgctctttgaatgacttctttttctactgctttaggaatcaccagaaccccctccaaatccccaaagataatatcacccgggaaaatgcgaaccccttcaatctcaatgggcactctgaagtcaataacctttcctcttggtgcctgatcctgggcatatctgccataggaaaaacatggaaattttaattcctctattccgtttgtatccctgtggaaaccatttgcaacagcccctgctgcgcctaaaatctgcattctggtacacatcagttcacccaccagagcgtaagaaggtgaagaaccggtacagatatatacttcattcttttttaaatcatctaacgcctccagcatcagtccaaaaggtttcttcataaggggattctgtccataggaaagttcttcaaacgcatcggcctccaacaccgtcattgcacgccccgccactaccattctggtattgaccggctgtatcttctggggcagaaactgatgaaaatagcccatcttatctaaaatatcaccgattacggctgaatacatttcacgcctcattaattcaaataattcatcatcatttttccattctatcataccctgctcctatcccaccactgcgccttgtgccgctgactggctgatttttttataagtatttaagtatccgtccgaaatttctttttccgggcggatccaatgtctttttctttcatttaatacggcgtcttccactaataaagagatttctctgttatctatatcaattcggatgatatcgccattctccaccagggcaagggttcctccttcgtaggcttccggcgatatatggcctacaaagcagcccctgttggatccggaaaaccttccgtctgttaccaatgcacagctgtctgacaaattcatgccttccagacatttcataggacgatacatttccggcataccagggcctcctttggggccttcatatcgcagaaccactatggtatttttttccaccagtccatctaatatggcgtggcacgcttcctgttcactctggaatacccgtgccttcccctctattctcatcaaatggcccggcatggccgcaggttttacaacggccccaaggggagcaagatttccacttaagactgcaactcctcctgttaaatgaaaggggtcactgatggatctgattacttcccttcgtttagaaaaacccagctgctttaaagattccttcatggtatgaccggtaatattcaggcattccaaacgaagcagaggctccaattccttcatgaccgacggcacacctccagcttcataaaaatccaccatatcgtagggagacgcaggataaaccgatgctatttgggggattcttctgcttaattcatcaaataaagtcagaggcaattcccctaatcctgcttccttgtgtatggcctgtaaatgcataatggcattggtcgatccgccgattcccattaaaacggccatggcattatatatggaatcttttgtaatgatcttacgggctgttatattttttacaaccagctcaacaactgcttctccggtggtgtatgcaatctgcatgcgcttggagtgaattgcaggtaccgccgcacttcccggcaaactcattcccaatgcttccgccatacagcccatggtatttgcagtccctaacatggcacaggaaccaacacagggctccgccaggttctctatttcccggaactcctcctgtgtgatttctccccgttgtttccagccaattgcttctgttacaatatttccgtcataatgcttatccttatatactgcaggcatcatggggccgctattacaaaaaacagaaggaatatccagtcttgcagcagccatcagcagccccggtacaattttatcgcaggaaccaagcaataccagtccatcaaatttatgggcccttaccatgcattcaacggaggcggttattaagtccctggatggcaaaatgtaccgcatcccatcatggccttccgctatgccgtcacatggggcaatgctgccgaacaccatagctgtacccctccggattcaattccttttttcacctgttcacacatttcatttatgttgaaatggcccggcgttgcattggtgtatgtattgacaatggcaatcagcggcttttccagagctgaatccgtaaatcccatagacttatacaacgctcttttcagtgcgcctccatctccttttaagagctgattgtagtattgatactcctccattctactttacctccacaaagtcattggctgcaaccaccggaagggtggcccctccctctatcattaaagaagtccctgtaatatatgccgctttatccgatgccagataaaccaccgcctgagcgatctcctttgtcgttgcaaaccgtttgaacggaagccgttctgccgcttccagccggatatccccaggctcccagcccacatccgtatagcccggagccactgctaccatacgtattccttttaacgacagctccatcgctgcattttttgtaaacttggcaacagccgcttttgtgggcccgtaaatggtggctcttggccagcatccttctacctgattggatgagatgttaatgattactcctttcacatttttttccaccattctttttgcggcaatctgactgctaaaaaacaatcctttccagtcaattgccgtcatatcatcaaacatcttttctgttgcctcgagaaaatacacttcactgctgatacctgcattgttcacaaccaaatctattacatcgaatttatcaaaggcaatctgatacatatgctcaatatctttgacacttcccaaatccgcatatacagccagactctctaccccatgctcccttgccgttttgcatatctcacaggctgcttccttgtcattgtggtaatttataacgatgttgtacccttcttccgctaaatccaaagaaatctgtttcccaatccctcttgctccacctgtaaccagcgctgtcttccgatgcatctttattcctcctcgttgtttaaacaaaccctttttctatattgtaattaattttgcataaaacagctttcacaatatggcactttctcaatgtctttgtgtattattcggaaccaaaagacgcagtcccgattttcggactgcgtctgacttttccttaattctctaagtttcatcttcaaaataaaaagcgaatttccctttcgtctaactctatacgttctgaggcctttaaaccggaacgtttataaaagcctgcagcatgagcattttacacattttcatcagctgtctgcataaagctgcacacctgatcactcactatttccagtgtgatgggagtcgtgtttcctttaagatttgaaaaagctttgttcctgatacatcaccaatcatcttcatcttgatcagattgaaattctctaatagagcagccatccggtaactccatatcctgaggtcctgtaatttctttgaccaggataaaaatatatctgccaactgcaaaatgaagattttttacagtatctgaaagcttactgtttgtaatcggtacaaacaaaagtacccctctatcttcctgatctgacagaggggcagcatttcccgccactctgttcagtgatacaggaaatgttttagttatttaaataatcagctacggcctcattcgctttccgaaccaaattctcttcgtccattcgcaccagccggccttctttcacaacaatattgccgtttacaaccgtataatccacactgcccttcagccctaccgtacacaaaaccgacattgggtcaaactgagcgcctatcatatcaatacggtttaaattgaccaggaaaaaatccgccgccataccttgagaaatttctcctaaattttcccggcccagcacccttgcactgcccttggttgcgattttcagcatatcatatccgctgggcgccttccggctgtcattcagcctgtggagaaggtagcccactctcatttcttccagaagattggagccgtcgttgctggctgatccgtccactgccaaacctacaggaacatccagattcagcatttccgggatggaagcaatgcctgaagacagcttcatgttggaaatgggacaatgagccacacctgtctgagttctggccaaaagctccagttcatcctcgttaaaatgaatcccgtgggcataccatacatcggggccgacccagcccaggctttccatatatgctaaaggccgcataccgaagtgagaaagggtaaattgttcctcatcctttgtctccgccagatgagtgtgaagtcttacccccagctttctggccagctttgccgattcctccaaaagttccccggtcacactgaagggcgaacagggagccaatgccacctggcgcatggaatatgggctgggatcatggaactttttcacagcagcttcggaatcctttaaaatctcatccactgtctggacaacggaatccggcggcaaaccgccgtccttcacactcagatccatactgcctcttgtggcgtgaaaacggatgccaagcgcttctgctgcagaaaactgggcatccaatagccctgtcccggcattctttgggaacacataatgatggtccaaacaggtggtacaccctgtttttaacagctccccaagtccggtaagggaactgtaataaaccacgttctcgtctacgtgcttccagatttcatataaagtttttaaccatgggaataattccatcctctgaacctgaggtaaattacggctgaaggtttgatataaatgatggtgagtattaataagtcccggatacatcaccatattagatgcgtcaatcacatcatcagctgtttgttcattgctgccgatttcggctattacaccgttctttatcagcacattcactccctccagcagtctgtcatctgcgtcacatgtcacaagatgttttacattctttacaagcagggttcctttcatcattacctcctagtattaaatacataacaagctttgtttcatagactatatgactggtgtactgccggcggttcgggtggccacgaaacaccctcatacgctaatcggtatatatgataccagcagtatgccgcgtgttcccagctacgttttaaacagctatatagatatgattttttcaaagaacaattgatactctgttattatattggttttctttttattattcaatgttaattatataacaattatcagaattattttgtgtaaaaatcacaattttttcagtcttctcccttcggctttatttgaaggacgcaacaaataagaggatactccaaaatcatatccggactaccctctttctcttcttttcttcgattataatatttccatatgcgcccaacacttataacctatttatttaccccttattcatatctctgagcagatgattaaagacagcaatgataaaggcagccagcagtgaattaagaaaacctcccatgcttatgtctgctacaaaatgatctgcgatcataatcgtccaggcattcacaataaagctgaatagtcctaaggtcagtaagttggccggcagtgtaagcaacagcagaatcggctttaatataaagtttactgccaacagtaccaatcccataataagaagtgccgggatgctgccaatataaaccgtgtgtgatacatatgacatcagatatatggttaatacgattgatatatattttatgaacggcttcgtcatttttacctccaatagacatgctttacctgattttaattaatactttgactttgccggtggtgacatccacaagattatatggttcatccccggataaggaatccagcagcttcatggctgcaataatgagtactttcactgaatggacggtgattggggaggatgaaccgggatcaggcacttttggtacaaaaaaacatgcgacagtcagtaaatcctgaaaacagtccaataattcctgaaagatatacaaggggattggaaagggaatacttatgaaccttctgttctcgatctggagcttgatcctcaaaaaatgaaagcccttaatcgacatacactttcacctttaccattgctttatggctttcatcccaggcttccacatcaacgatattcggatcatccaaggtaccgtttatgatctcctcgattatctttgcaaaatcgatgctggaaatattgatccccttggcttccatctctcttctggcatcagcaggaaccatagtagtcatcttatcagcaatttcactgatcgtagtcagcaaacgtaacggtatatttacgttaacattaacggaattatcatccgacgttacttttactttaaggaacttatagtttcgtcttgcagcagttacagcttcaaccctttggattgattctgttcccttagtcacattcagagcttccaaaagctccataccttcggcagcggtaatctgccctttttctatcatttccagtattctttgttgttcactcatggactgaccctcctattaattatagatttttaattcgttccgttgcttcctttggggagattttaccttttgataattggtcaagaatttcattcctggcggttgctttatcttcattctccttaattgattcttttgatgatacttcatacccaaggcctcttatgaccgaatccagtttcccccggaccgtgggataagagatgcccagttctttctcaacatccttgatattaccgcggcatcttatgaacaccttgacaaactcaagatcttcttccggaaggcggcagaattcacaaggctggaaatctccttcaatgattgtggagcacttgggacagccaagccttgttatggaaagcttttcgccgcatacggggcatttgcccggagctttgtatttcattattttcaccatcctgatgtgttatttgactataatatacaactatatattaaaaatgtcaatattaaaatcaattatattaatttttatattaatataattgatttaaaaatcaaatatattaagcctgttctttaatgattttaattttgctgaaagatggagtggattcatgatcagattcatttgataataaaaatccacctgtctctttcctgtctcctttgccccgcctgtccaggctctgagttttttttcaatcatccggtttacacacaaccggccaaggatcactttgggcataagaaatagacacttacacaggacatacattgtacgggtttccattttcattttattgtctgtacctttgagaaaattattgcctaggtctaaaactgccccactctctacagagcttacatcacgctgcagcctcttgataatatcaaatattcaaacgcactgaataaattacattttcctctaacaaaaaaggagcaaaagcccgattgcctctgcaccccgtttaatattttgataaattttttataatttcttattttgtacattaaaacatggctatggacttgcagtgcatattacggccttttggcacttttatttgacagcagtttatctaaatatatggatttaaattgtttgctggccattacctgctttaaagggggcagcttaagaatcactccaagtactgccgccatcgcacgatgattggcaaatgcctggttatcaaatatgagattttggagggttcccttttcgattgcctgcagtacaaatctatgggtactattcaccggcgtaataacttgaacctctcttcgcactaactcaatggcatctttaggacaactccgcacacatactccacaaccaagacatacttcatgatccacttgagctgttctcttacccccgctgttgtttttcatagaaattgccaataccggacataccttttcgcatttgccacagcctacacattgctttgaaatctcaggtatataatttgtagtggccaccggctgcattgggctgaattttcttgctgcctgcagtgcttcacagcagcagccgcagcaattgcagataaatgccggggcttcacgaacattttctccaatttgcaccagattagcagcataagaacgttctaatacatccattgcctctttcttatcaattaacctcgcatggtgtccattttctgcaagagaacgggcaacattaccaaaggtgaggcaaacatccaatggggcatttatttcacatgggtggccggcatgcagcatcttatgcctgcaataacaagttccaaggcctatatgaaccgcttcctcaataatatggctcgctctttcgtaatccaaaatatgaattgtattttcattagtcagaaccggctcctgcacgtaaactcgtccaaggtgcgtctctgttgcgaagaataagtccttaacaaaatcttcttctacgttcatatactgataatacaattcacttaaaaatttctggtcaatatcacctcttgtgcgcatcaatgcaaattcaataaaccctgccattggcggcggcattacaaattgacgcaccccatcataaaatgaatccacaagtaacgctttcccgcaaagatgttctaaaaaagcttctgctttccattcactggtattccagatttttgctgctttttttgcagtaaatggacgaaccggcaatagcgagacccatttggcttccttttccgtataaaggacctgcaaaattttatacaggctgtccgacggaggggccccttgtgtaaaccaattgattctttcttctaaattcttataggcatccttacttgtaatatgtcccatggattcaccttcctaatattaagtttggatagacttataactactttatcaaattgtatccattaatgtctgattcacaccctgtacttcctcaaaaccggcgtgaccttatctgcataacagcctttgtgtcacaacatcagaatatatctccatgccagcggtttcagcaatatgaattacatctgaaaactgttcgctttggggtaataaagaagccaaccgattctcctccttaagaatgcggtcagggttaaatactacatctttgtatccatcaaaaatggccacataaaaaatccctgcctcaacgatatcctgaaaaaaatgacttccataggacagctccggcataaatcctgcttttctcgatgagtactcacaaatgaccgtcatgttacacaattcagtaaaatgtaccggtacacctaaggatggtgttgtacttccccatctgcccggacctgccagcatgacatgtttccctttcatttctttgttgatcaaaccgatctgcctggccacagcatatttcccctgctcgttcagctctaagtatgtgttcgccggaataaacacaataaaatcaatgggcaggcgtacacttccccccataaaatttccttttccggagaaaaagcaatccttatgatccgccagctccggtatttttactgtgctgcctaaacctttggtttgcaatgggcggcattgcagaagattgattttgaaaagattgtctttttttagattagctgtaaattcaatatcaacagggtaatcataggcttgggacaataatgccagaatttctttcaatactgaggcgatctctgtatccgtgaacaatttcttaaaatctaaaatatgaggaatctttcgatccatatatcccagctcacgcattcgggactctgttgcataatcagggctcataaacatcttcttatctgtttttaaatccagcgaaaggatttcatccaggtctatgctttctaaatcattatctttaaaagaaagaatatccaaccgatgctgggagaacttattctgatcctcataattcatgggggaattcgcaaaggattatccaaacatacaaccttcacataatcaccatccgtccggttaactgcccttgtaccaaggccaaataccagacgaagcatccctgaattcatatcaatgctctcatcccagacataaagattagaagaatttcccacaccggcaacatggggaaaaaagtattctccatattgatcgcctgaaacacgctggaccaatatagccatttgttcgtccagttcaaaaagccccctgttcatcctgtaatcaagtgcatcctcattcattgtgcttgcataaacagtacgaatggcctgttcaaaggcttcataccggtcctcaggagttccttgattcacgcagaaaacactttcatattttcccgcaaatgcattcccaaagttatcctcaagcagagagctggaacgaatgataattggagactgtccgaaatattccagcatctgcaaaaactgttcctgaatgtccttagggaactttccgtgaaaaagcttatctctcagttcaggtgcatacttataatatccctccttcgtcttttgctttgcacgaagtctccaccaaccgttttgtacaatataggtgtaaaaaacatccgccccgatatagaaggaatcatgaggttccatgaatggcgtgaaacgattttttccttcaatctccagaatctttctggccaaaagcatacccacactttttccgccaataaaaccgctgccgacttccctggatgcaatcatcagaatatctcttaaggtaaaatagcggtcacacagttcaaacattctggaatcactgcctatcagcatatacattaagtgcttcttcgtttcttcctgctgcttaagggaaccgttcaacacctcttttgctctgttaaaaatgacattccaataatctagccggttttccccccgctgaatgttagtaaacaactcagaagcgtcagagctggccgtgatacagacagcctcctggccttgaatcaaatgagggaaaaacatggtaggcgaataccgctgccataccttgagggggtgaatatatgttttattatttacctgatatatatcaagtaaaagctgagtcgtttcacgaatacctgcaattgtgctgtaggtatgaaagtttcgtataatagcgaaatatgctaccgtatccaattcatatagatatggacaggtggccttaaaaaaattgccgatcatcaaatccgaatgccagtattttagcagatcagtcagacaatcaaaaacatacaagacccttttaccctcttttttaatcaggttatatatttctgtagtaaaactttcaaaccctttactggcatcgatgcgatataccttgatatcctggctgtcagccagtatctgttcatggctggcaaaacggatgtaaaccaatctcatatgatccatcttagcctttacaacaaaatgatcaaccattttcttatagtcagagaccgaatccgcctgccagactacattatctccaagccgaagatggtcaattacctgatcaaaaccatttaaaccggtacttactttatcgtgtaaattcatagcacaccccatttcaaatttatcactatttcattatttcagcttaactattttttcataccgttataaaaacacctccaaactgagtcattctaatttacatcagcttggagggttacacattccttgagatactcccgtcagctttatgcaacagagctctgctctcaaccgtttttaatattttgtaatacatttttaagatggcctaccacagctgcttttgccttttctttatctctttccttaagcgcctgaataatgtcacgatgttctttatatatctcctgtctgcggtttgcattcttagtagtatgggcagcaacctcatcaatgatatcataataggaatcaataaaattcataaacatcgcattatgggaaagctctgcaagacgatagtgaaaatagtgatcaatggaacgcgctccttttttcttgtctgtttctgaaatcagatcatataattctgcaatctcctcatcagatgcagtttcaataattttctccacagttctttgttctaagcaaatgcgcatttcaattaaatcgctgtaagtaccttcttttagtgtaattcctgctgaaacattcataatatctaaaatattcggattaacaaatgtaccttctttcggctttctacagatataatttcttgcttgtaatatcgtcagggcttctcttagaattcctctgcttacgcagaattcatcagccaaatcaagttcatttggtaatttatctccaggttttaaagttccgtcttttatctgttccattataacccgtacaactttatctgataatctttcattctcaattggagcaaaacccatattgatacctcgcttcatctctaactttacgtttaaaaggtctaatactttaattataccttaattaatagataagtcaacgaattgccttgacctctccctgcaatacagaacctatatcctatcctgtgaacggatcggcagagtttcacagcaaagataatatatgctaaatctctataatttcaaaatcaccgaataaggttctccccataccaatggacccacagccaaacatgccgtaccggaagctgtcatcttttatttctaatatcttctcatcatctatggacaaggcaatccaatcacctgctgcttccagagtgagtttataagcagtcccttgcttccagtcaaaatcagtttccaccagtttcttaaaaccaaaatcatttttataaattgcagcttttccctcttctgaaaatccggcaatatatccacgcattacaccttgagcacggatttgtaacaggtggctttccccattgaccggagtaaccggcaccgtcagccttacatcctttgaaaaataattaccggcataagcaaaagatggttcacacctcatcagagacagcgcttctccgtcttttgcccaggctccatgattcatagaaaatggggtaattgtaccaaattcatttcgctgctttgcgattttaacagtgtacctgcttttacctgtaatagaaaattcatctaagtataagaatcccagggttttggcctttgcaatggaataaccttcaattacaataccgacttcatcaattaaatccccgtctgcctccggtatcacaaaggtcaagtcaatccattccccctgtactgatttaacatatccctgtaaatgctccttcttatcgctcatggaacggacataaggcgctatcccaagtgtttcccagccgttccattgatccagataaagcttcatggatactgtctggcccggatatgccgtaggtgtaaaaaccggcatataacgctcatcagaaaattcatcccggcggtaaaaaggtttatagtaaagcttacactgatttccccgtgtcatacgatcaattaatattttcagggagccgtttcctttgtatgctatatcagtggaatggcctgcagtgcaataaaatgaatctgataacctcatattatgagtggatcccggaagttcaaaatcaaaatgcacttctccttcttttatactgttaagaagggaggcaggggctttttccccggccagtctgtaccccagcagagcaacttcctttgcgtaagtaggtacatccagattattcaaatagccggaaactccggataaaataatgccatcattgattggcttgcgatacctttccggcagtccttcgatcccgcacataacacccagcacggttcctgcattgcctgcattacagtctgtatcccagccgcacatggtggcaatttcaactgtctttgcaaagtctccattcccatataccatggataaggcacatactcctgcgttaggtattatatggcagacaccgccgtatttatcatacccccaatcacgtaccagcatgttataacaatcacgccaattattattttctttgtgaaaatcaagtactgcatttacaacctttgtatataagctatgttcagggatctgcgacagcccgacttggataatttcatggatatcctggcattggaacgcatgggcaatgcatgcgcagaaaaaacgggcgccatatattccttctccgtcatgggacacactggcggcactctgcccgaactcagctgctttgtccggccggcacggattcaccagtccccaggtatcaatgaatatctggcctccgatctgttctgcaagcaattggccattttgattcacggacccggattggggtgcaggaatgccatgctttaaatttaagtaagccgtatgctccgtgctgatgccatagccgccccaccagaacatgccaacaccctcacgggcataattcagccatgccctggcaacatcctggggtttcaaatcaccgtcttttgcatcatcatataaagcccggagaaaataaaccggcccattcacatcatcatctgcggcaaaatttttatagtcttttacataatccgtaatttcaccgtatgtatttaaaatacgctcataagtccatatggttggctctacaggagcccctaaacgaataccaatattcatccccaaaaatccggaatataccttttccaaatatttatcaggtatcatattctcattctcctttgataactatgacctgtccgtcaaccagacagacaggccataggatattatttaattaaggctgccaatctggctgcccggtcaaagatgtcaattccttttgtaaagcccaaacaggttccggatggatatctggttttttgcagccacttctccggtatgccttttgccccgtattttgctccaagaacagccccggctacagctccaatggtatctgcatcccgcccgaaattgccggcgagaatcaagcctgacttaaaactgccatgttctaatttcaggcacccaaatacttccggcagcgcttcggccaccgtagaacggtgtgtggagaataattcataatgcaatggcatccaggcatctgcaatatcaccgtttgcatcatctactatttgaaaggctcgtaataatgtttctctgaaccaggacccttttggtgctgtttttaaaacagagtctaatatttcgtccatggaagcatccaccattgccagggatactgcaacggcaacggcctgtgctccccagacgccatccatatgatggcttacgctggcatcaatttccgccagtctggccgctctttccggatcacctgcacataggataccgattgggccgcttctcatagcagctccatcgcttaaatagtaagcattgaatcttcctgattccggcggacgcatgcctctccgcagattattgcatgcttccacttcgctgacaccgccgcgtttcagctcatcttctgttgccacatgtcttaaccacatcgttactacatcttctgaagtaaaatcaccaccggcctcaattatggtttctgccgtcaaaagggcaaattccgtatcatccgtactccaggaagagcctttattaaagtccgtagtgattccgtaatctctctggttttccgggcttcttgcggcatcaccgaaggagtcaccgatcgctaagccacagagtgaaccgattgctttatccagcgcagcttctttattttgaatcagatattctcttgttaacatcatacgttcctttcttcccctggttatttcaatattgtgttcgcgtattccgtaatttccgctccgcctaatgcattccaatctgcaacaaattgatcaaattcatcaatggaacggttaccgcttattacatccgcggcaaattctatgtaaagtgcctgacttgcatcccagtttgttgcatattcatccggtataacaaatccattgtcaaaagaggaataggtattgaccatgtctaaagatttaagggctgcttcgctgaaatacggagtcttatctgatataggcgcatcaaaatttgcaattgattcatggaaacgaggccaccattctgatattttatcggttaatacaatttcattgttctctatattgtattcttcaccttcgtagcccaatttatcaagaagctgaccttcctgaccagccatatactctaagactgcaaaagcaacatccttattttcagaatatttgctgattgcccaaccgcgggattccttgctgacatctcctggagtatatccttgtgctgcaccctttgccgggggaagaataactaatttcgcattttcaccattttgtgtaaccatcttattattgtaaatattaatcacactgccctgggttccgcttacaactccaacttcgccattgtaaaaggcactttcttttgtatcccatttttttgttaaccattcattatccaacaagccctctttataaagctctgcataaaaagccaatttttctttttctgcatttgtaactttactgtaaacatatttatcaccttcttttatccaggttgccttaaccccaaaggccagattaaatacagtatccagctctgttatatctccaggaacggtaaatgcagcttttagattgttgttctcctttaattcctgaaagaatgctttataattatctgcagttgggtcatccaaaagtgttttacttgattttgccgcatcaaaccagtcttgtctcacaaccggaacctttattctatccggtgacaaccatataagatatggatagttggctaacctttccttgttatatggctgcattaatgctttaatattcgttgaatcattgacatattgggtcaagtcttccaaaattccctgggtaatggcaaattgataatcaccgccctggaaatacatcagatccggaatctcgccgctttgaagcagcaggctcatactttcagagtaagttccatcagagatcggagccagttcaatatgtacttcccggccaagctcttttgaaacaccgctgcttactgcctccagaaatcttacggaaacttcatcatctgctgacaaatccttaattactgccttaattgttacagatgccgaatcattggcaatatcctgggtgctctgtacattggaactggaatcaatcttttttccgcagcctgccagggacagtactgccattcccacaacgaataaatatgaaatcgtttttttcattttacattccctccataaaattaatataatttttttctgtgccttctcacaaaactatctgtaatctactcttttacacctcctgacataacaccgctggtatagtatttaagaataattggatatagtaataaaattggtacaacagccactacaatggttgcagcttttaaggaagcgttatccagctgtgcaatattattattagctaaaatattggatgctcccacaattacctgggaatctgaattaactacaaattgtcttaaaagcacctgtaaaacagtgtgatttttgctggttaaaaagatacttgatttaaaaaattcattccagcggaacaccgcataaaacattcctaccgtgatcaatgggattctgcataaaggaatcatgatcttaaataagatgttataatgcccggctccatcaattcttgcagcatcttgaatggaagccggcacctcttccataaatctcattaatatgatcaggtaataaacgtttacgcttctgtaaataaccatggaaaacaggttatccaataaatgaatattcttcatcaaaaaatattcctgtacaattcccggttcaaatatcatcataataataaagaaatacataaagacctttttgccaaccagtcccggccttgttaatacataggccgcactggaagtcaatgttatatttaaaaacacacctgcagccgtaataaataatgagttcagtatgcttctgattacaataggctgtcctagaatgacctgataattcaccgtagaaaatcccttgggcagaatatcatatcctttcaggccatgaaccaaatccggttgtgaaagagatcttgccagtatattcaataatggaactaacatacataaagctaaaagcatcataataaagccgcacagaagtttgccaattgatattttctttcttcttttcatacttatcctcctaccatgcccccttaccggtcagctttttggaaaacagatgggtagaaacaattaagagcgtacctattacacctttaaataagttcgctgctgttgccaaggaatactgggaattctgcagaccgatccggtaaacataggtgtctatgatatcgatcttagaattgaccgcagcattggtaaagttcagcacctgatccagacctgcattcataaagaaaccgatattcagaattaaaaccgtgaccattgttacagccaaagccggcagtacgatgcttccaacaatctgaaaacggttggccccatctattcttgcagcttcatatagagtggggtctatccccataattgccgttaaatatacaatggaatcccacccaatggatctccaggattctgatgccagcagaacccatctgattgaacctttgcttgttaacaaatttactttttcaaaaccaagaccagtcaaaatgctgtttaaaatcccggtagatggggataaaaactcaaaccatattcccgcgattacaacccaggaaaggaaatgaggcagataagaaatcacctgtacactctttcgaaaaggacctgctttaaattcatttaacataatagcgaaaataataggcatagggaaaaacaggaatatcttcatcccactgataatcaaagtgttttccagtatctgtaaaaataccggagttgaaaataactttttaaaatatgtaaatcctacaaatacattgtcacccttgattcggtaatcataaaaggccaatttcataccaatgatcggaatcacatggaatacaaaaaaatatagtaaagtgggcagtaaggtaagatataaaaccctgtcccgccagatgcgctttaactttgattgtccccctcctgcttctcgttttgccatcacccgtacactccctttctaaatgctgacgattaattcacttaaaggtgcatgttgttgtgccccataaacatcggtatcataacaagtacctgatgatatttttctcgcaaatgtaattttaaaccccaacgccttatcataaaatacaatttgtgtaatcttatcctctgtcaaccggtatagattgcaaatcgtagttttattaataatattactgttttttattttttgatatattaccggatcatcaaaaagcacatccagcgtaatctcaaagggtccactgttttttgaacgtattacttttgcacaatcgtataaactgcattccgccattttatctcctcctttccattacatatcagggtattcaatgggaaacatctgacaactatcttctacttccattaagtgataaacagaaaattcatatactgcaccaaatggaatatcacttggcgcgaacggaaaagccagatttccggcagttgattttcttccggcataaccataatgaagtaaaccggatcggagcgaaccgcacactgcattggcaagttcctgggattttgcaattacctcaaaaacaattcccacttcatgaggtaattcttttgaaggctccaactctcccattacaccattcattccataattaataaagtgaatggtataatcttcttccggtatatccgaataataagttctaacttgttcttctgcgagtctctctatttcctctaaccgtgatatcataagagaatcccttaccccagctaccacaaaggttctgtaggcgaccttcatggctccctctaatttaatacaataaggagtagatttttcgatcctgcttccggttacaaatacgctcttttcatcaacctgcttaaattcacaatcttctaaatcaagggtaatccccggaccgtggaggatatagggatgatctttttcataaaatgtgtgtgctgccacagaaagaggagtgcaaattctttcatcagataacggtgtgatcataaatccttcctctgttattgttccaagcatacaatctttcgtagttcccggtacggcacaaagggctgcacactcaagaatcttgccggcatgatatccatagcttaagggaaatccgtgatacacggctaccgccgcaaagggagatgggtcataagctcttccgcagattattatatcagctttggattctaatgctttagcaatgggttcatgccccatctgagccacaatcccattggtcagttccaaccgttcttccgtcaatttttttacagaaagacctaagggctgcactttgccatgatgtaatttttctcttaccgcttccttaggaatatccgcccatatgattgctaccttttgtgattccaaagcctgttccttaagaatttcttttataatattccaggtccattccacatgaactcttcccccgcttcctccggctgacccgattattaccggaatcttagcttttgcaccttccgtaatcatgatttccaagtcttttttacaggccttttcacttacaattgccactccggcacctaatttatggggtcctgcatcagtacttcccgcatccacaacaattgcatccggtttataagacattcctttcagaaaagaggacttgggatatccataacccagtattccgcatggcgccagtatttttatttctttcttcatatgacctccagaatttaatgtactattaaaaactcataagtttatttatttaattgtttaacaattaaattatagcacaacaaaggatcaagtcaataatattttccagaatttaaatgtttatctttaaaagttaaagaagcttttgcatttagctgattcgctctttgcaaaagcttctatatcaaatagttatttttctacagcatgagcaattaatttccggaacgactcttcaaaatacttatcatcttccatagttctctttcttggtccgcttagatgatttttagattttgctcttcttgctacttttgccatatgccgttccatgagaagctgatctatgttgtcattggtataccatcttccagattgatgaatcgcataggcagcctttcccagtaccattgctgccacaccataatcctgtgtcaccacaatatcaccagatctgcataagtttaccaaggcaaaatctactgcatccgctcctgcaccgacaatctttatgtcactgtaagcagactgtaacacatgatttgtatcacatagcagacatacttctatcttatttcctgctgctactttttccacaattttaactaccggacaggcatctgcatccacataaatcttcatttattttttctcctcatcaagtctattaaaagggaattattttactttttcaagaaatatttcaggcacttcttttatcagcaatatactatttacagagtaattaaatgtataaccagcctttggcatgaaaccggcattaatcagatgaacaacaggcctttcatgtctgcttcctgctttcatggcagtttccatatttattgtaaacggactaacatcatgctttttggttctcattgctgtaacagtttgcgtttaatcactgataccacaggccgcgggatcatccgcttccctatgctcttgttctttagcgaattcgggatcacggatattgccaacgataacaattgctacgatgaaaatagtaaatgtgaacacaaatggcaagcggcggtcaatgcttgataaccagccggcaaagtagccaaacggtgaggcaaaagcaatggtaaaggacataatcaaagcattaatacgggcacgctcctttgggttaatgtttagctggagcaaggcatctttacgaggcactacaagagcactggctactgccgcaacaaaaacataaatgataataagggacatacttccgaccggagccaatatcagaagaatcgagcacgcggcgtacaatattaaaccgatccacatgggtatccggaatttcaccgattccaggcggtgctgtattccaatcatgaaaatcaacatcacagcagcatttaaaatagggaaaaaagccagataacgatctgcaatgcctaatctttgtgttacatacaagctgaagaagttggtattgacaagattcgttatatgtaatatcacagagacaatcagcactttcataatctctttattctttactactttgggtatcagatccttgtattcgtataacatctgtaaaacaggggtatctttcgtctcagccatacgaatctttccctgccgggtttcttcacaatgccgaaaagtaacaatcactttaatcagcatattcaaagcgaaaacaaaatataagacacgaacaaccggaaccacggtaaaggaatttattaacaaccctgaaattggcgcaaaaaagattgcaaccagaccgcctatgttgacccaggtatatattcctaataaatccttggaatcggcatcttcaatcaataaacaaaaccatgccgtctggttaatctgctcaaaactgttaaataaaactgcaattaagaagagccagaagtttcccgatacggcccatatcatgcaagcaacactccagccaaagaaatcacccatcatggttgtaaattttcgcccaaacttatctgtgatgataccgccaatgaaggaaaaaaacacctgaacaaacatggcaaccgacagcatcagcccgatttgaacgtccgtgattccctgtgtgtacatatacagtgtggcaaaaggtgcgattaagttatacggaatcccccagagaggctctataaaaattagagttcttggatttcctttattctgtttcaataattcaattagcggatgcttccgcagagtttttattttttgtgctgtattcactggtttctccattctacgaatgtttctatattatattcatggctgtttagtcaattactatggaagagaacgaagcgacaagcagacaatgctgtaccagccatttcactccttggttctgagatgaaggatgctcagtccttgttttttataaaatagctatactgaatatagtatttcaactcttatctttcgatatgtaattcagcaatctttttaccagaagccaatacctccgttcctgtttgtcagttctctttgtaaatccaggaattttgcggctgcatataatcctcataatgggatagacagccatatctgaaacaatgccgaaatccattccgatgctttgcgtctggtttcaaaaccaacgtaacctttataattataaaggtaatctattttccactggcctgcttgtatttgtttctcctgaaggagatccagcaaggattcacagttttctgttgcagttagctgtctttttccaacgatatagattaaatcagtgagggagagcgcataatttgggggaaacattatgtctgtaatatgcggactgatgggtctcccatccgataaccgctgaaacatattatgacgaagcatatagtctgtcccctgcataagaagactttctgctttgcgatctacacattttgcacactccatataggtggcaagcgcacggacggtttttccgactccaatatagcatggtgtttttccaagacaaccaccgtgtttgcaaatacctttataaggccatggagtggtttgattacgttcaaatagctgatattgctcgatccaccttaaagcgacttttacttctttactatcagaaaaaccaagccggcaataggcttccaacaacatggcattgtagcaagggacgatttcttctaccccgcccaaacatgaaaagccttcggttgtggcaatgtttcggtttatataatcaattatttttttggtgtaaggcaatctttcaatataagggatttcacttagtcccataacccgaaatacagcaaataaagggtgatccacaaaatcaccggtaagcttgccgaccagtttggattgacttaatagatgagcaatttcgttattatctaaatattcgtttttttcatgggcaatccttaaaattagtgctgtatccatgttacacctcttagaaatttaattgattaaataatcgtggttatctgcattgtatttaaatggcctttggttcaaagctactcgatcaattggatttccattatgattcataaccaattgtttcaagccaatttatgacgtcttcctgtgcagcagcaccgtttacagcaatgccaggtaagattacagactttgagcattctttcattatatctttttcaatctgtccaaacccaccgcctccatgagtgcaaaagggaattacaattttgcctgtaaaatcatgctgcctgaggaagctcaacactggcggcgctactgtcttaaaccagttaggtgttcctataaatattgttttataatcatttatttcctcatatccagatattagcttaggagtgtatcctaaagaaatttgatttctcacttctttagcagctgtattatagtcaaaggaataattcttttcaggaattaactctcttaaagtgccgccagtctgcaatgctatttctaatgccaaattctctgtgttatgaaaaagtgaataatatacaatcaacgtattatccatatgggctatatcctttcgtaatcgtaaatttattttggcaaggccatgccttttatcagtcataatatccacaatggcatatccatagggcttaaactggcttagttatttacaatatgactgtattcatcatattcatctccccactatctaaaaataatctaaaatcaagatattgatattccttccagacagaattaagtaactaatttaaaatctattttgcctcgttccacaccgttgacaataagtgtaattgaatgaattcccggataatgcttccttgtacttaaatctgcaaaggaatgttttttagtgtaaaacttcttctcattttcattcaatgaaatttcagaaatttgaaaaatctttctatttctttttccattagcttttacataatcgatcccatattccagccttacttttgtcgcttcatttgtcaaaatattaaatgaaaaagtaatatcctctccaagcgaaatagaggtcgactctaaaataaaatcagcaacatctatagaattagcatcatggtatccaaaaacagccaatacatcacgattgcctttttttagcaatgttctgcatccgtgctttacaatccagttagtgtattcatttttaccataccaatcctttgccagctttgcaactaaatccgggtgtgttttagaaatgtcgtttagattattggcaacactctttcgtacatacaatgatggatcggtttttagctgctccaatatcggcagaattggcgtagggtcttttttatatttggttaatatctgactccatggcaacagaggccggcagccctcactagcaagcctgcggacgtgttcattttcatgcttagaccaagcatacatctgtgccatcatacgttcctcatggttaatgataaatggccttactgcaaactctgaagatgaatgtgaggtgtatctctctaaggcgtttatggataaatcccaattcccttcatcctgcccataaacctcaacaaagtccgggaaaaaaatacctgaaaaaccagaaggacagccctcaacaactttattaagtatgacaagagcttcactatattctaccggtaaatattttcccagactcatacttatttttcgtactctggcttttaactctaaatcatcccaagtctcgtccattgttgtttttaagaactcgtcgacctgaaatgagtgataaactgattgaatagccaatgcaatctcacgaagcgattcatgattgaacatattttttaataaatccggcattttttctccttttgcagtatgctctctcctaattatttgcttcacaaaatataaattctctacaactgctaaaacaaagactcttaaccacaataacgtcttatataattaaactttattcgttttcttacccactctactaaaagggaatatatttaacgaataccaaacataaaaacacacctacaagacaatctcaagatctgaaagacctttgtattactgggatttctgctccagctatacgactgtttccacatgtgttgttgctgcaattttgataactgtcgaacctgataccccttgacgcgagggtataattatattaattccaacactcaacacttgttctttataaaatatttatactaatgataacacggcaacgctcttttttcgatatctaatttggcaaagataaaagctactaagactaaaaaccctcatcgtactgagatcctttgccttaacagcctttaatataaatcaatatctcatttttttaattatttctctttataaattgaaatatgacaacgtaccattatatttataaggatataagtttaaattttctttttagtctactctattgatcggctgtccattagaaaaagctctaatattatcttggatcaatgaaactaaacgttgtctagtttctaatccccgccatcccatgtgtggagtaactataacactatccattgtatataatggacttgcatcatctaatggttcaaattcttgcacatctaatcccgcacctgcaattacattattttgcaatgcgtcaatcaatgcattttcatcaattaacgctccacgtgcagtattgactaaatatgctgtcggtttcatcattgctaaggtttctttattgatcatgtgtcttgttgattcgcttaaagggcaattaagagaaataaaatcactttgcattaaaacttcttcatttgttgtaaagtgaatattctcctcatctgctctgggggttctggtcgatactaaaattttcattcccattgcttgagctactttgattatttcttttgcaatatttccataaccgataactcccagtgttttaccatttaattccacatggtccaccattaaatgtttatgaaaattatcatgattaccttccgaaagcatacgaatttgtttttgcattgagcttgccaggtttaaaatcataaggattgctgtatgggccactcgttcactgctatacgcagggatgttacataatattattcctttttcacgcactgcatccaaatctatattattatatccagttccggcttcgcaaatcatctttacactatggggaaattttctaataaaatcacctgtgactttcatttctttcgttacaacaatagtaaaaccgtcgactcgctctaaaattttatcttcagacgtttcatcatagattaccacttcagatgcaatttgtgagtaatcaatgttcccatcataatttaccaaactggcatttaaaaccacagttttatcattcataattttatctccttcatatcacctatattttaacctgttttaaggatgttaaaagcagctttttcagcctgtatttcacctcaaaatcgtccgcaattcataacatcttgtggtcaaatcctacgacttactttccaagctacaacgctgcagcaccactacacattccacatgcattgaggcggaagtcttataatacatggcgaaaacatactagcatattaaagtgggaggtaacctttttccccatttattatatttccgtgccataataaaacattactcttaattaagtcttatctttacattatatagataacaagcattcggcttgctgtttaacatacagtcctaataatcaaaagaaaaaagccgaaatacaaccttattttttaagtattctctttatggaagcgacatctaacaaattcactgtctcaaattttcctttataaaacaccccccagttattgaaaacacaaggcaattcctttgctttttgtagcgtatccacttgaataaaagatacaggaacgtcattcatttcacaatattgttttaccatttcaatgctttgatagacataggggcattgcatatcataataaatagttagctctttgctttcaatttcttggtttttaacattttgtgcgaactttggcgttgttccgtcaaaagaaagtgcaagcaactcatatccgttattggtagtatcaacaacctcaaagccgaacttcttcgcaaatgattggtcagaaagaaaagatttttgtttttttgctccaagcatacaaatgccggatttccccctttctttagcatcatccaaacaatacttcatcagcaatttcccatacccttttcctttgtaactgccagaaacccataagcaatacagataataatagttttcaccagttatgggaacccaagctgtttcaagaggagcgtattcaataaaaactgtagccttctcatttaactttctaaagacatgaccttcatttagccggtctgaaagccattgtttctttgcttcaataccttgatggggctttttactgcggataatgcagcataaatgctcattgacaagattttctgttgttaagttcacaaaatcagtattcatatttaccctcctttaaattatcatctcttgcttattaggctgctaaaaaatgattaacatatacatttattgtgattgttcaaatgatgtgttatttaaaaaaacttcctccatctttgcatccgagctttctatagaaatgctgggctccttcgacaactggtgtatcattcactaccacatgatcatttatcctatgtaagattgctttaaccccttaagtactccgcaccaccagggatagacacgataaaattatttaaataattctttccaccattatccatcgatttcactccaataatccacatacaatccatatctagtttgatctcaaattcctatataaaaaccactcaaagcacttaaaatatccattctactgaaccctctccataaaaacaatctcaaccgtactgcttcatttcagccatacggttgagagaatggtattgatgtcaataaaacaactaatactatttagactatattctttgcacgaggatttgtaatatttcttcataagatagtcctgttgtttattatgattctctagtaaatgctataaaaaaattttcgctggtcttgttacaaaagttacaggcaatcctaataaatcaagacatttgttcctgatctctcagattgtctatgtataaagctgtttcttctgaaatattcgtaccactaatatatattctaaattgctccacaaataattaatccacaaggtcattttggaatcttgaaagatgctcgtacggaagaataagtcttcctcggtaaaggccgcagccatcattaataagtgaattattcactgctgaaaacatatttacatccaattttgataattcaagctgctgcagcatgatacctctttcataagcatcatcaaaataaatattttctcctttaggaattgcatctcgtttggctctttcactttcctgtcgtttttcgtaacctaaatgattggcaggaccaatttcagcgaaatcgtccatttcttttgtacgaagttgtacttccacataacaacgtgctatgttatcataaaatgttatatgcagcgaacgatagccattagtctctggatttacaacataatctctataatatgggcttatgctctctcttaacaaaggcgattttttctgaccctttaaagaagctatttctgcagtaaatccgcgttcctccatgaaacccagcaactggttggcaacatcatatagatattttttttcttcatccgcgcaattttcaccttctttcagatgacatttgggaagggaaatcacaattctgtatgcaatcaggtcccgaaaacagtttaaatagtctttcagttcaggaagagaaggataattgccgtgtttcatataatactcgtaaatatattccacaatatatccgttaaattttgcttccgcgcgtatcagagatttaattcggcccttaaaagtaaatgcaagaaaaggatattcatttgccatatatttatagaagtcccgaatccgctgagactgtgaagtcaggaattcgttgtgctgtaaaagttccgcaatttgaagtagaaaattacagtgcacaagatcaatctgattatgagtttctttcgacgactgtttcaaatcctcggtatatctctgtaatatcttaagaacggtatcgcctgaatataaataatcatttaactttttcattataattttccgcatctgttcattttttcacagatgcaatttcctttcctgagtgcttaaatatctatttatcaaaaaatgatcaatatttccaactcattttatcgctgaaacaaaatcaaatatatcagatatattcaatcatacccagctctttatgtgttatagtttcccgtcaccatccgacctgaccactcacccgactatgacatctaaatcactttgtcacaagcattacggctagttttgatatgttcccgttcagccaaaaaataaagcttttcaaacatctgatttcaacctcttaatcacacaaaagtcctgtatcaagcctttaaaatagcctttcctacaccttgtcatcaaaactccacatgtgatgttactgcaattctgatgactgccgaatctggtgcccccttggcgtcaaggtacatattcaataattctgacgctcaaccttacttatttataaatcagctataccaattataacatgacatcccttatttttcgatgtctaatttaacaaagataaaagctgttaacaataaaacccccattactgagggttttaattttagcagttttccaacaaaaaccaatatctctgttcctgcttgtgttttttattgtaattttattactatccactcatcataaaaacgaagccccatagtttcaattcgatacgagccctttgtcgtgctgatgcagattaccgcagccttcaagttttttctcatccaaccagctatcagagctgctgtatgcgaatccggccttctatctatcaattttaacagacagtataaatggtgaaaaaagtttttcacatggcagggataaagataaatcattaaacatctgcatctgttgcaaaggcctctgaacccattggcgaaattgtgacataaaggcgtaagatatcttcaccggtgtttataacctgcaggctttcctgcccatcaacctgcattaactcgcccacctgcaacgaagtttcattgccatctgtgacaaccttggcatttcccttcatgacctgaaggaaaagggttgactctagatgtgtgtgtcccggtagtatctccccttttgcaatgtttaaaacaaaggcaattacattatcgcttttaaaaagcatccgcttggcgatttttccttgtggctcatgaaaataatcattgaaaataaacttgttcatggattaatcctcctttaatttaagcttaaaatttaatataccccaattggggattaaaatttttttcaatccctttttccaaaaacattttcggctttattttgtggggaaaatctaataaaacagattctgaatcagaatcactgactcacatgctatgggacagcaattctatattatataatgtaacctattgcaactatttcatagacattttcaattttttaataatctcttctaatgactccatcagagcctttgccatttcaaattcattcgttcggagcagctgttgaattctggtttctaactcttttttcttttgctccagcagcagataatctttgtcgaaatgattggcgtaaatcatctgtctgaatttacggttgctcattctgcgcacagtattattttctaccaaaagcacataatccatgcaattggctaccgtataataatcatgggacaccataagaattccacctttgtactctgaaaccgcctgttctaatgcaatctgagcataaacatccaaatgccctgtcggttcatccaacagaaggaggttggctttttctaatgagagcactgctaattgaaacaaatctttctctccaccagataattcactcactttctggccaagggtatctccttcaaaaccatattttttcaaatagttctctgtatcatttattgtaccaaatcctttatcttcgaaaatttcaagcaacgttttctcattgtcatataatgagcctgtaatctgggaaaacatgctgacctttgcatcttcactaatcctgatcgtgtctttcttattttcaaagatttcgcatagcattgttgtttttccggttccattattccccacaattgccacatgctctgcaggcttcatttcaaaatccacatgttctaaaagctgctcatcaaatgcaacgttataatcctttaattccagaatattttcatctgccacttccttttccagtccaaaataaatctccggctgtttgatgtccacaaaaggagcctttgtttttctttctttcagccgatccaccaaggtctgtcttgcatgtacggctcttccaagggatgcgttgtccatttccgacgcttttgctctggatctttgtaagattttactttgacggtcaatctcagcttggtctgcagctgctgcttcttctaaatcaatcttcgtagcgagaagttcataattatattctgtataggttccattaaattcctgaacatccatattttccatgtgaagtatcttgttaaagcaatggtttaacaagtaccggttatgcgtgataataagaagcgttcccttgtgggcattgatcagacttcttaatgcattcagatgcttaaaatccaaaaacacatccggctcgtccataataaggaaccttggactcagcatcatctccctgatcacctgaaccagcttaaattccccgccactcaggctgctgatcttctgatcttctaacttttgcagattggctagttttaattgcttcttaatattgatttcgtaagactctccatcaatcgcattccattcatctaattccttttgatacccttcgaatatcttttccagatctgcagcagtttccatttccttacaaaagtcaaatatcttctgctcatgctttacaaactcatcactgatatactgaaacacggtcatatcttcttttggatctagctgcgaaaattgactgacatatccaattctgtctgtgttgtcaatttctatttttccatcatacagatactctttggagtgcatcagcaaatcgagtaacgtactttttcctgtaccgttagaaccaatcaatgcacaatgtacatcatcttctattgtaaatgaaacttttttatataaatccttttgcggatacgagtaggacaagttttgaaccttaatcatgattgcctcctgtggcatttattttcgatataattctgatacaagtttcacaatgtggtggggccgttttttataattcatatcaaaatcccctttaccacacctgatgttaattaaacaagattattaagtgagcaattgatatgagtaggaagaaagttgatggcagcgaacgatggaccataacggcttttcttcgcctctttctccccaactttaaaaggtgctggcgttccaagaagctaacaccggcacctttatttaagcccggactccactgtttttgcagtaaatccagtgctgtactatagttataacgctcagcagttttaagcctccgctaatacactcttatgtcgcttcaaatatctaccgctgcctttctttccaaggaattcattatctttgacaatgacacatcctctcagcagtacaaggtcaatatcaccttttaccttcattccttcgtagcaggtgtagtcggcagcaccatgcatatccccatgagtcagagtacgttccttattgggatctaaaatcactacatccgcatcagaacctggtaaaagtgtccccttctgcggatacatgccgtacatacgggaaggattggtgcataaatatttcaccatctgaggaagtgtaattcttcccttttgtaccccctctgaaaaaataacgcgcatccgctcttccacgccgggggcgccgttgggacaagcggtaaaatcattggcaccagcctgtttttttgtagtaaaattaaatgggcagtgatctgttccgatggtatcaagcacattgtcctgcagcgcctgccacatggcttcaatatcttcatttttacgaagcggcggggaaaggattgctttaaatccttcgatatcatcctcgtacatctcatcagtcagagtcaaatactgagtgcaagtttccactgcaaaattcttctgatgagcggccttcgctttcatgacctcaagaataccttctttgctggataagtgcacgatataaagcggcgcctcccctgccatggctgcgatatgcagcagtctgtccactgcttctgcctcgcagcgggccggacggcttaaggggtgatatttgggctgtgtatatcctttttccacataggtctttctgagataacctaaaacgccgtcattctcacaatgtacggcaatcacaatcccatccttttttgcctgcttcataacctggtatatctcatcatcattcaacttaaaattataggttgtatagatcttaaagctagtaattccctctttttggatatttcacccatttccttcaggatagactcattcacatgctgaatcacaccgtgaaacccataatcaactaccgctttgccatcagccagtctgtgatattcctctacctgatgccagagactgcagccaaccggaccaaatgccatatgatctacaatcgtcgtcgttcctccgcatgccgccgcaaccgtcccatcataaaaatcatctaccgcacgatactttccggactgtaaatccatatgggtatgaacatccacgccgccgggaagcacatactttcccgtagcatcaatcacctcggcctcctcagcaggaagattttttccgactgccttaatccattcaccttctataaggagatccccctgaaacacttctgaatctgtaacaatcatgccatttttaattaatttattcataatgcctccttatgagcttgtaatcgtaatggttttatagtacaccctatattgtgtacttgtctattcttttctttcagccggatattaaatcctgtgagaaaaattattgataacaaagcaccgatgactgtcttgtgatttttaagagctttgaccttctctcaacgtctcagccacgttttcctctttcagctactcttatatccttatttattgcacgttattttctgattttttcaggcgtttttggggcaacagaactatggatttacatgccctgcggagttaataaggatattaacaaaatctagtcattcattggcggcaattttttcagtaaaaatggatttatatcatattctatttctacatagaacatcaaattatctttaagacaacagcttaaaggtattgttccattaactgttctaaaccgatttctgatgttagcttttcaagattattaaatattttctcttcgtcccagttccaccattgaatcattagcaaaaattcaaccttttgatcactaaatcgtttcttgataaacttagctggattcccgccatgtattgtatagggttcaacattttttactatagtagagttcgcggcaatgattgcaccatcgccaattttaacacctggcataatagttacattttgccctatccaaacatcattacctatcactgtatcccccttgaaaggcaattgatctactgttggagtgatcttttcccagccaccgccaaagatattaaatggataagttgtaattccgtccattctgtgatttgctccattcataataaacttaatgccctctgctattgcgcagaatttacctattattaatttatctcccatgaactcataatgatgttctatattattgtagaatttctctggagaatttttattatcgctgtaataggtatattctccaatctctatatttaattttttaggcagattacttatatagcaaaccgtctttatattttcatttggataaagtttattcttatctggtccaatcataaccattcgctcctcccaacctgattaaacgatagataaagatatgaagcaaacttgctagtagattaactgaccaatcttcccgcattcctctgtaaaccatatggctccgtctggtccaagaacaaggtcatgtggttctgaacctatggtgggaatttgatgttcaattatttcgccacatgatttaagcctgccaatctggttgcttccccattctgtaaaccagagttcaccttctttacccgatataattgcatggggtttagcatctcgtgttgacagcgagtattcagtaaattggcccgacgttgtaattcgacctattttgttacctattatttctacgaaccaaatggctccatctccccctttacaaattccaactgggccagaggcagtagttggaatgctaaatacagttatctccccagatatactaattctaccgatcctgttaccttggttctctgtaaaccaaagtgctccatctgaaccgtctataatcattgacggaaatgaacccaggtcaggtaaattatactcactaatttccccattcacggtgattcttccaattttattgccagtaatctctgtgaaccacattgctccatcagggcctgatgttatcccgcaaggacctgcattggcagtcggtatatcatattctgtaacttttccttctgttgtaatttttcctattttattagctttatattctgtaaaccatataactccatccattccttttgttataattagtggctctgcatctagggtcggaagtaaatactctgtaattttaccttccattgtaattcgtcctattttatttcctgtattttctgtaaaccaaatagctccgtcatgtcctgcagtaattccatatggccctgatttgtccatctcgagcttatattcatttatattcatttacttattatcctttcattttaaaaacaaaaaacctttcccaactaaaagtctcggaaaggttataagtgtctcatcatagaagtttaatattaaagagctattttaaaataaaaatagcaaattaacacgatataaattctaattaaattgacattattataatcctatccaaaacttacagcagtttaagtaatacaaaaccagcataccttaaatattaaaagtatacccgctttgtctatactactataacttataaaaactggatatgattatatgatcattttaattaattacctcgtgtttatttttatatatttaaagtatattacttttaagcttataattcaacaatttgctgtgaattttttatttattatcataaatgcattttagcactttaatctggggagcaagatggattaagttcactagctcttgttatcagtgctatcgtttctgtatgccttattgctgcaattttgataaccatcgagcctggtacccccttggcgtcagaatatattttcgacaaattcgacgctcaacctttttttataaaatagctacatttattataacatggaaactctcattttttgatatctaattttaatcttagccgcttttcagtatagcaactgcttttttaatacccaataaatttaggtttaactcttctgcctgcgatttgttctattgcataagctgtgtttaatagttcttcgtccgtttgagcgatgatatttattccaaaaggcattccatcattatatagcccgcagggtactgtaatcgccggtaaacctgtatattgaacaattgggtgatctttaaatacaatacatacatttaaatcctttagctgatccttcatatatagtttagtgaactctatatcttttaacgtatccagataaatagattctgtcatttcaccagaggtattattctgggcatcttctaataatatttgaccatatcttaaagtttcttctttatgaatattgttaaattcaattatttcctttaaattttttattttataatctagtggtaactcagctaaatattgattcatagcatgcttaaactcatactttttaatattatctatttttttattaggaattgttttgagatggattcgttttaagatcgcaccagcatcctttaacttatttaaaacaccattagccttcttttcttcttcctgcgacatattatctatagcagattgatcaattcctattacagtacctttaagatttgtcctttctgtaaagtgtattttattagctgatatttcattaataataatgattgaatctttaacggttcttgtcatgggaccaaccatatcaagagaaaagcttatcggaataatcccttttatgcttaaagtaccctttcctggacgataccctacaataccattctttaaaccgggagatatgatagagccggaagtatctgtgccaaaagctgccgtacataaattagctgctactgcaactcctgaaccggtgctggaacctgccgggttttcacctaaaacgtatggtgattttacaattcctcctttggaactatatccgtttggcattcctttcgtcatataattggcaaattcagtcatatttgtttttccaagaataacagcacccttttttctcaaaatttcaacaatctcagcgtccgtttctggacttgaatctgccaatgccagtgaccctgcggatgtgtgcaaactatctgcagtatttatattatcttttaaaagaataggcaccccataaagcaaaccagaatcatccttatttctttcatcaagctcctctgctattgtaataacatcagaatttatctcaagaatagaatttaatccatttaaacctttgtcgaaagagtcaatttgctctaaatattgtgaaacaatctcttttattgagaaagtcttattttttattatcttacttaattcagttattgttatttcgcttaaatttattttggctgtcatattaatctcctgcatctatttgacgttctcacatgaatcaatcatagttttatcttttctattatcttcctatatatttcgatttattcatagtaatgtcagcagataagtattataaagcttatacccaataatacgttgcagcattgcaacactgaaaagaaatggtgttatgggacaattgacaaaaactttttgccatttcctcctgaaacttattaaaacttgatctgaaacaatagccggatggctgtcctgtacataataatgatcgcgttgactgatattcttgctcttcttacctgtcaagaaatcttctgtaaaagtcttttgcagaattgtatcgcctttatacttttcatttataattcttcattatcgatataaaatgtggcagcagattaagactccacccaaaagaaaagacgtgaaagtatcctctcacgtcaaaatatgttgctatctataattctataaatcctctatttatcaagtatctaaccgttgcaacaggactatgaaacctacatgccttgagtgagtaaaaataatgctgaaaacgcatactccttcccaggggttttacgctttcgtattaattctgaatatctcatccaacactctgccgtcacaaggaccgaaatcaatgcctaggattgctgcaatcgtaggagctatatctaccatctggatttctcccaactggtattctttcttaatacaatttcctgataccacaaagccacatccatactctggtctctccggtgaatacccatgtgttgcatactttctattttctttctccaagtcagtcacaagggacccggtaaggctgtcatcaaaacagtaaccagtcttcgcttccagcatatactcagaaaccgggaacgcatgaaaacgttccagttcttctctggtatagatcctctcaatacctaagttcttctcttctgccgcttttagaagaatctgtagtacacgctgctttgcttcctcgtcattttcctttaagtgcagataggcagaccctcctgcagactgtatataggctctccaaaacattttccctttttcttcataaatgaggccttcttcttttaacaattgattcagcttcaccttgtaccttacatttttctgcccatgatctcccaacaccagaaaaaccgtttcctcaaaaatgcctgcctcccgaactgcctccataatcttaccgattctttcatccatccgggtcagaaccttatcaatctcaggactgtctgtcccatgatgatgcttcgcgtcgtccagttcaatgaagtgcatcatcagaagttccggttttttgcttagaatggtgtcttttccgcacatagctgtaaaatcatccaggtaaggctgttcaatcccttttcttgattttccatattttttctcaagcccaatacaaaaaaatggacttccattttttaagatcttaagagattgattctcacgtccgattgcctttatctccggaagattatagcgaatggaggcctttccggtaacaggccacaggattcctgctgatttcatttcactatttcttaaagcatcatacacagcaggtgccttgatatcctttttaaaccagaaccacgcctgttcttcttcatcaataaaaggctggagaggggtattatgatagattccatgcttatccggataaacgccggtcaccatagtggtatgcactacataggtaagagtcggatagacgctttttaattttgtactgaatgctccgctttttattaatcgggaaaggttgggaagccgacttgccttttcccagttatcttcagaaaatgcatcataggagatcactaccaaatgctttgcttttcctttgctcatttttccagctccatcatctttcatcttatttttgttctttaggaagtatcataaaaatcactaatccaattaaaaaaagaggaataattcccaaaatactccatctggcattaccggtaattgctgttataagggacatcagcgttggacccaaaatggccgagaatttaccgaatatattataaaatccaaaaaattcattggatttttcctttggaataatctttgcataataggaccggcttagcgcctgaatccctccctgtgcagaaccaatcatggctccaagaatgaaaatatgccatagggaagctaaaaaaaatgcagcaatacaggtaatgatataagtaaatattccgatgataatcatggttctggcagaaagccgtttcgccaggtttccataaaagatggcacagggaaaggcgatcagctgtattatcagtaaaattcccagcaatgaaaatgtatccagtgtatggttcccaaggacagcggtggcataaggaactaccattttaattatggtatccacaccatcaatatagaaaaaatatgcaccaagaaagtagaatacggttttatactgcctgatctgtttaaatgtttccgccagtcttttaaaactgtttcttattggatgttgttcgggttccacataatgaatctgttttacatcttttatcataggaaaagttaagagtccccaccataaagcagtaatgataaatccgatctgatatccgattgacttgtccatccccaaaagaaatatgagcgccagactgatgccaaaaggtatgacactggatatatagccgaacgcaaaaccaagggaagatatcttatccattctctcatcactggtaacatcaacgataaatgcatcgtagaaaatattggatcctgcaaatccaattgccgataaaataaaaaaaagaattaaaagctgccattgtccgctggagggaggaataaacgccagcgaagcggttgcaaggacacccagacaggtaaagaatacaaaaaaccgtttctttttatctttataatcggcggcggcacctaaaaccggacttaaaaccgccactagaatactggcaatggagttaaaataccccagatccatgctgtatctcacattgtcaaacattccgaacataatcggcagtaatgcagtggtgacagccattgagtaagccgaatttccgcaatcaaccaatatccatgatttctcttctctgcttaacttcattattgaatactccttccagcctttatgatccaattatatcataaggttaagcattgtcttgtaaaaacattgtaaaagagcatttggctttctgctttatttataatccattccttacagtacggcaccttccgttagtttccctcttttttgatccgacaatcggattgccatgtttgtctttcttacatttgctttaaaaatcctttttgattcttttgccaattgaatctgttatattatgctctaataccatttattgccctcctaaaacatatttatatatcacagcatcgaatgttacttttctttcctcctcatagccggtcatgttatcctctcttccgacacagttcgtcaatgcatactgtgtgtcttgagaggtcaaaaaagatgctgcttgagcctgggaataccttgaaggaaggtcgcttagctcttattctatatttcgacttccgttaaggttaaattcatcgctctccctccgaccttgacttcaaaaattttattttcctttatagctaaagacactctgatttcagatggcctattcatagaataaccttgttcaaaaataatatgtgaagcttgctcctcgtcgatttttccatagtggtacaaataacaaccaagtgcaccgcttgatgttcctgtggcagattcctccgggataccatataagggagcaaagtttctacaataagcgttagcaccatgtaaggatttcaaagaaaaaacatggtatccaaccgtattgtacttctggctgatttcttttacttttttcatatccggtctgatcgcatctaaaatctcaatgcttcttacaggaaccataatatcccgaagcactgttgatacaacttgaaccaacaagtctgctgtaatttgggaagtactgatattcaaggaatctgctacttcatctttgtctataacttccgaaaatacaggaatggattgatccatcataacaaaattatcgttgtgaatttcaatgccaagtattcctgctctggtttcctgctcatacttaccttgctttaacaaatttagacttgacattgcattgaaggtggcaatcgtggcatgaccacataagtccacctcttcattcggtgtgaagaatctcactttaaaatctgccacgtttgatttgaaaacaaaagcagtttcactgaatccaagaacagcagcagtttttctcatttcttcctcagataatgaatctgcattcataacaacacctgctgggtttccgccttctttcgttttagcaaaagaatttaatgtgtatacgtttattttcatatattcccaaactcctatatttcacttaagaattaacttactataaaaacaattgaattatgtcatgctatgttataattcgacaattacttcagtatgccttaatgtgcaataatgatgccatatgtatctgttaaccacttggcggcaggatatcacctccaaaagtcttcactgatcgatcagcaaaaaaatagaattagcttcttttctgcctgattgtatgaataaacgatctcattttatattactctgcatctggaaacttgtgccgccattctctttcataatacttgcttgcatcatccaatttggtgccaatgaagctcaaacaggtatgttctcatgacaacctctcgcctcacattatgaatacgtattttgagttgctggaaagctccttgcaataagcaaatcctagctcctgaaaatccttgagaccattcagatctgaaatattattctctgccatgaaccgcaccatatcaccgcgagccatcttagatattgttcccttttgtttcactttcccttccactagctcaccaaactcaatcgtaataaatcgatcctttggtgtgatatatttctcgatgcattgtgagtattctttcgaagccaagttaaggataattctgtcatcgtccactagactatgatacaaccggtctccccagaaatcatataaatctttacaatcattcacggatagctttgcctgcatttctagtcgatatggcgttaccccatcaaagggcttaagtactccatagaagcctgacaaaatccgcaaatgatctgataggtacgaaagtgccttagttgtaagcactttcggagccatatgctgatactgcaagccctcatatgctattactgccggtgtcagtctatgcatcaaagccatatctttgtagcgcttatagtttaattctgccaatttatcattgcatttccacaatgcttttccctctgataaggacaaggacttcatttcatgcatcaatattatagcatcattaataaatccgggcactccggtaacctcaatagaatccgtatcctcaatcatcttctttgccggagaaattattatcttcatatcctaaactgcgccagcatttgtgccggattctcctctgccttcactttgccaaaggcttttacaattattccatcttcatcgatgtgatatgtggttcgaaccactcccatgctaaccttaccataatttattttttcctgccagacatcatatgcctgaatacaggtaagttccgtatcagaaagcaatgtaaatgctggtgtttttgttcctgcctgtaccatgatcttacctcctggttcttatgttaagcataaaatccttctattccgcctttttagtattcatttcactattacaacttccttcaatgcctatacttctatatcactatgccatcgcagtggtcgatttcatgttgtataatttgtgcaatccatccggaatacttctggcagtgtttattgaaattcatatcctgaaactctaccacgatatccttatatctgatggtcttgcgaactccaatcaaagaaagacagccttcttccgtctcgtacgcaccagacttcttcacaatcaccggattaatcatagcaatattagcaaaacccatactcactgctattattctcttcttgacacctatcatgttagccgccagtcctacacaacctacttcattcgcctttaacgtatcaagcaaatcctgaaccacctgcttatccgcttccgttgccggttctgacttctgattcagaaaaaagacatccttcattactgatctaatcattacaaaccttctttcatttgctcaggatagttgtatttcagagcattctacccctaagacattaatgtatatttaccctacggtacaattacgctaatgcctatctttatttactgtattatttacttatccgtttagatatgtcaaattggtatatttaccctacagtacaatcacaccaatgcctatcttaatttttatattatttacttatccgttttaacatgtcaaattagcataacttttctgcacttctgcctcaggttttctgcaacagagttattacctccacatgtgttgagtgtgcaattctgatgaccgctgggcatggtactcccttggtgtcagaacatatttcataaactgttccattcagccgttattgtttttatctatactaaaaaaataactttctatgttctttattttaccatagaaagctatttttgttcagagcttttttcagtattctgagaatcttatttttatttaataggcacagcctcaaaagtaatgacatctttaacatttgatggatactgcccaaatttataatctgaagaaatcacgatatctttaaaccccgtgctttcaagtatcaatttaaactcttccagtccataccattgtagcggaaagcgttctaattcggtttgaataagcactccctcacgccatttttcatacctgttatgtgaaacagtatattgatttatatagtcaacttccacgattttactttctaaagtaatgatatcgccattcaaacagacccatgcccttgtggaagccgtacctacagaaaaatctgtctgcatgaatatatcaatcattaatcgtcctccagtgcataaatgcttatgaaaattttgcagtgctcttattgagtctgctctttggtgcatcagaaggaacgttcccgttggaactataatcgcatcatatctcgtatcctgtataaaagattccatattcgcttcaaaaagcttaggattaagacctttttttatgcaattgtcacggcatatattcagcatgtcttttgaactgtcaaagccatctactgtaaaccctttttctaaaagcggaatcagcatacgaccggttccagttgcaggctcaagaatatgccccctgcacaagcttaatctatcaatgtaaaattctacatctccaaaagaatgacctataggcttatctatatcatatacctctgaagacaggctgccataataacttaacatattttagttcctcttttattaattctaaacctattaaaaccagcttaattgagttgactctttataagtagcatatcatcaaatcgtatcgcacaagaatattattttacttttttaataggaatataaatatccataacggtatcttttctgtgatgacagcgttcatcatagaattcaaaatcaattttactttcatcgtaaatatactcactatctttaaaccaatcttcaaaaatatatttccacgtacttgcaataatctctgcaaactctatttgttcttcatcatttgaagtatccacaggagccgttgtaaaaactgcatactcagcctccggaacctctactgtcagcatatctttctctgcccttgaaaaatcatcaacaattacccctaaaagatatattacatttccatcttcagataacggaacacacaatccaacttcaccgtgtttagcgggatttaaaattctgtacattttgctttctaaattttcaccttcataattattccaataagatgcaatatcttttgtatatgtaatcccggtaatattggttttgattccataaccagcaactttaaatgcaggtcttttaacaataacaggctccataatataacctcccatttcaaatgttgtttttgtatcagcatattgagccagtcgcatcatgtactgtgtaggactataaccataagctttacgaaaagctttagcaaatccgctgggggtttcaaatccataatcaaaagcaatatcaataatttttcttttattgaataattctgttgttgctaaagctaacctgcgtcctcgcatgtattccataacagatatacccttacataaactaaaaactctgcaaaaatggtaaagcgaataccctgattgattagcaatttcttcaatagtaatatcttcttttatatggtcttcaatgaattcaatacatttttcaatttctttcctataattcaatgcttaccacccctgcctttcttccataggatagctttattataacaacaacttataaaaggagctgttcctgttttgctaactatgaatacacaataaaattataactggtttacagctgaagtgtcctcttgttcttttttaactaaaagaggctaaaatcgagtatttcaactccaattttagcccttttcttccttcatgtgtcgacatcttgtggtcaaagtttgcttttgttcataaaatcgcaaaacgtcatcattattatagtatccacataccttgttgctgtaattcaaatgaccatcgaagccacttatcccttggcgtcagtgtatattttcaaagagccaaaatataattacttacttttcattcaacttaaagcacaaattcgaaaatcatgctacaagatgtacactttcattccaactctctctcaatttcttcgatggaagggaggctactccgtaattcttctggtaaggatttctccatttgatttttccattctgctacaccaattggattctgatatccagataaagaatactccacaactgtctgatttttgcccttaaccaaaagtaaaccaatagttggtttatcgtctggatggcatagaatatcatttaccacattttgatacatattaagttgacttataaaaccaggctcaaaatcacaggctttcaattcaatgactacatagcaacgtaatttaagatgatagaacagcaaatcaatatagaagtcctgcccacctacctccagatgtacttgtctgcccacaaatgcaaatccctgccctaattctaataaaaacttctggatatgtgtagtcaattgacgctcgatttcaacctcacgtcgcggcatatctgttcctaaaaagtcaaataaatatggatctttaaatatttgatttgccatatcagaatctaccggcggaagcgctgacggaaaattattaacggttctaccggtacgctccatcaatttgctttgtatctgcaagtccaaaatagtgctgctccacccattttccattgctttttgtgcataccagatgcggctttcttcatcttccaatttatctatcagtttgagattagttctccatggaatttgtgcagcaacctgttgcacaatttcataatctggccaacactgagcaaacttacgcatgtactttatgtttcttggagagaaaccggacatttccggaaatgcttccttcaaatcttttgccattcggtctataaccttggctccccagccttcttcctcttgcttcttcaaaattgctcttccaatattccagtagaggcggatcatattggaatttgcattcattacaacagtaattctctgtttttgaacttcatttttgatttcttctataaactgcaaatagctatcactcatttcggaaagatttggagcaaccggaaaaataactccctctttattgtttcccatatgttttctgctattcaatattttcacctccaagttccattattatgataaagtatttgaatttactaatcaaaaattcaagtggaaatatttctaaaacaaatttactttttttacagtacctcaatataattgacaagttctttatcttcaatattattctacactggtttctgtatgcagtgaaataatttttttatattccatagcataagaaacaagtagatttctattaccctcattactcaatttcacgtattataattattgataagttgcatttgacttgtatattttaatcttatcaaaatcaaaaccttgtgaagctaaaaaaaactgaatatcaaaaattgtcacttcacatttagatccaataataacttcttttaaaaagttatcctttattttggtaaagttcaagtcaaaataaggaatcaattttgtttgtgttgttctaaatgatattttttcccgaacaaatccattattatattgacatttcttattataattttcatctatttgtccagccacttcatcgttattatcatgctcatagctatatacattagataaatgaatatttacatataatctccactccttttcttctttaaaggcattatttttaaattgtggactatcattgcgtattgctcctatatgcaaacacatatcccatataaactcatttaatgtttcattgttaatttcatttgcctctgccaactcataagcagttactaattcgcccaaataattttcaatatattttctttgctccttaatactgtacatcaccttcttaaaatgaaaattataccccccagtatcaaaagtctttaaaacctttttattaaaccccaaagaaatacccctggcatcgtttgcataccctctccattgacttaataaatctccttgttcagaaaaacacgctatatatgtaaccattttccttgtgttctcatgaaatactttattaattgtagcgtctatctgcagacctattttttcaatcaaactatctgtaatacaatatttagtacaaaatagttcactatcttttattttacttaaaaatatatcctttaccaaatttgcaatccatttagtttcttggttatcatttgtttttgtacaatccgataatcttatagtctgattgctgattatactgttaaaagtctccaaactgcaataatgatataaaatatctttcatacatcaaacctcttctgtatctttaatggaatgcctcacactctgtgcaaaacaaagtttccttaaaggttaaaaaatagtttctcacattcctttgattggaagttttatattgagtagcaaaaccacctttcatttttatatagagagcaaaagtttctctacacttcaaattaaatgtatgttatttaccactctcatctgaaatattgctccttcttctatgctccgcaagagctacacgatctggttctatttgaccttttgatatagtcatgcctatatatcgcaaaatatacgctttaaatatttgactatgatcactccttttttttacgcatattctgaagttactatctaatgagaaatagcccaattcaaatgctttgtcatgaataggacataaacacaaaccattagatgtatctccacgcttttcactattatcggcccacctagcaatatgagaggcaattaaaaattccctatctgaaatcgtacattccggaaagcaacatcgattattataattattttttacattagccgaaaaatgcgcatgtcctacccgaacctttatttgttttatagccacagatgtcggtacggataagccaacagaaaagccttcctcaccagacgcttcgttattctctaatattatatccaatagcatttcatcaacttcagacagatatcctccgtttaagcattgtaatctattcgattgtattgtataaaatatattccttggtttggctttttgctcataatacttcttaaaatccagactatgttccttgaataattgataaagactgatgggtttattaaatcttataaagtcgcttaaaaaagctctataaaaactgctacaataagcccaacttccggggctcggaggacgttccaaggtttcatgaccatcagccttagcaattgaatatccaacaaattctgcctttttcccttttcctctaagatgaaagacaatatctccagtcttcactttattcacattaaccaaaatggccatgactttttttctccttcacttttcttatatgtcggagcccagatacactttgtaaatccccattcatcacccccatgtttttcgtcacggctcatctcaatccacattttcatttctcgtcactccccaatttaatctttatcggcacataatgctttgatagcctgttaaatagctgtatagtcttacattttgaggttaataaatatcgtgcctttggtcaaaacgtcctttttccttactccctgaaatactttgacttactgggctttcttttccagcagaaccaccgtcttcacttgcggtgaaagttgtcttttatactacatggcaaaagattttcctatcttttttattatagagtacctaactttgggaattaccccttttgatgatttttcacccctcttagtaaaaatttacccccctttaccccacattaaatagtaaatgcattgctgaaatgtatgcattgttttcgcataataatattttttactatatcaagttcgaaacagcaacaacttttctatatcccacctcttaataatatattaattatctaaatttcctttttgacaagttccttctattgtgttctaaattgatagatttcttacagctaaatagtataattcataatttctcaaacacttttcatgccatttgtcataacgccactctaaaaagctatctcgctccccttttcctatgtcattacaaagttcccaagctaaatcgtaaacactttggcaaaaattataagcactttcatagtacgtatcatatcgctccccgccatgctctatatcatttaaatcaccgaaaattattttatgtcgtttaatataagccatatttaaaacttcgccatatttatctctcataatatatctattttggaataaatcatatgcacgttctacttctaacaaaaattgtttacattctttaacaattggttctgttaaacccataatttcaaatatagaaatttccttatttaaattaatcattcttgaagttcgataattttcattaaatattaaattataattagtgaaattactatcaggaatcgttctcgcaatccaattagaactggtaagtctcctatcttctaaatcatgatacacattaatccatattcttgccgatttgccatattgggtcttgtattttatgtatacttcatctacaatcctttgaatatcatcatcggtaaatgacaactcggacacatatacacccaatgttactttttgaccaaaagatttttctctattttcaaattcttggatatcaaatgacagtctactgtttgacacagcttttgccttatcataaagcaaatcaccataaattccaatcgtatttagatattcaataatttggggttttatatcatgtggaataattatctttttgataattccttcaatatccaagctccctttttccactaaattgtctttacggtcaaaagcataaccaaaatatatacctgttcctccttgtattattgctctagggtttgaatacgctatacccatgtcataatcaataacagcattttttgtaatagcttctttaatttcttcatcagatagatctaggtgtaattcatttttcactgcatcctttattactcgaaagttatataaatccccttgtgctattcgcatcaaaatttttatttgtacactgttaaaattgcatgctttatctctatcgattataaaaacagccccatctttatcatgttgtgtatcgtcttctattacaaaataaagtgacacagacggatttatagacaaatcacataaacgtgtcttctcaccccaatgctgtaattctagtattttctttaaaacctcttccgtctgaactagactaaattttcgacattcttctgccaccttatccttcacacaattccctcgaaatgcccctggaactatatcccactcagaaacagcttgacctctgaataaattattgcctttgtacttctcaactatttgataatattcttctactgaatttattctgattgtttcaacatcaatcattagaatatccccctcttatctattatcagttcaaattacatcatacactacgagtttttacacagaaaaagagttgactaaaacaatcctaatactaaagtcgataccaactaatagttttgccgccgaatatacattttgcaagattgtatcttttatccaacaaaaccctcatttttaaactatccggcgttatccccgtccccttatctgcgaaaacttatccatctcaccttccgcaaaaacacaacttcattttacactgaaaaacccgcaaccccgcctagaatcaaggtttccgcacgagcaatgcaaccgtttccacatgcagagcctgcggaaacatatcacaccctctaaccttcttcacctcataccctctctccgccaaatacttcatatccctcgccaaagtagccgaatcacagctcacataaaccactcttttcggtcccatctttacaatgatatccaaacacgccgcatcacagccctttctgggaggatcaaccacgatcacatccgcatacacatgattcttttcatgctgctccggcaatacttcttccgccttccccacaaaaaactccacattatcaatcccattcaacctggcattttccctggcatcctcgatggcctggggcacaatctccactccatacaccttctttgccttttgcgccaggaaaagagagatcgtcccaatgccgcagtaaagatcccaaaccgtttccccgcctgtcagtcctgcatattcaagggcagtgccataaagcttttccgtctgcaccggattaacctgataaaaggacagaggagaaatgcggtatttcacctctccaatataatctgtaatataccccggcccgtaaaggttttccacccgatctccaaggatcacattggttctctccttattaatattaaaggaaatgctggccatacccttgatttccagaaggctctccaccaattccccgctatgtggcaaactgctgccattaataacctgacagaccataatttcccctgtccggaaccctttacggatcaaagtatgcctgaccagtcccttatgagtagcctcatcataaggcagcaaatgatacctctccatatgtgccttaatccgccttaaaacctcctggttctcctctatccccaggagacagtcctcacaccctatgatggaatgggtacgccccgcataaaaccccgtaataatattaccgtccttatccaatccccatggaaactgtgccttattcctgtatctccaaggctcgtccattcccataataggcagcataggaacttcagaaaaaccgccgatcctggtgatattattataaatcttccgttccttataccggagctgttcctcataatccattgcctgaagctgacagccaccacatgggccggcaaccggacacttaggtattacacggtttaaagacggctccgtgatccgttccagctttgcgaaaccatatgattttttagttttcatcaccttggcctcaaccctgtctccaataaccgtatctttaataaaccaggtaaatccatcagtctttccgattccctccccagtttcgctcatatcttcaattattacctctattctatcattcttcttccactctgccatcataacctccagtttatatatacacttcaggtttggctgccctgccaagccaaaaacattttcaagcaaaacttcctcagacccaagcattcccaaaccaaaatctcctcaaaacaaagcattttcaaaccaatacttttcaaaccaaatccacctcaaaacaaatcttcctcaagtcaaatcttcctcaagtcaaatcttcctcaagccaattcttcctaaaacaaaccttcctctagccaattcttcctcaagccaattcttcctcaacccaaactttcctcaacccaatccttcctcaacccaaaccttcctcaacccaatccttcctcaacccaatccttcctcaaccaaatccttccccaaaccaactccacctcaaaccaataccttctcaaactcccccagccccacctcaatcctacatcacccacacaccatatccacatcctgaccttattctaacttctttttccacaaaaaacaagaaaaccttgcaagaaacctatggccctcccccaagacaaaaaaacaggagcaagacggctccggtaagacatgttgtcttccttcctcgtccagctcccggaaatttatctgccttttccgttggctttttccatatggatattttttcctttgatctttacatccttcatggcctgtaatatggcgtcagcgttttctctcggcacctctacaaaggtatacttgtcatacatgtcaatgcttccaaccatctttccaggcataccggattctccggcaatggctccaaggatatctcccggcttcacattctgattctttccgatattaatgaacagacgggccatatcttctctgggagaagaatcgtatcttcctccccggccgtttccgtttctgctgctactgctgcgtccccggcttccgccgccgtagagattatccagggtatcaagggaacgaggctctcttgtatcgatgatatcctcattttcctcacccatcatcattttaagcaatgcagctgccaggtcaagagaagtgtaatcttcttccaaaagcttcttttcaatgatgttcactgtcttgcttaaatctgtatctccgatggtgtccgccacggactctaaaatcttatccacctttatggctgttacgtcatttaaagatgggatagcctgaggaacgatcttggtcttgcagtaacgctgaatgtcacgaagcttataaacctctttaccaactacaaagctgaacgcaatgccttcacggccagcacggccggtacggccgattctgtgaacataatattcatcatcctggggaaggtcgtaattgaatacggcttctacgtcgtctacgtcgattccacgggctgccacgtcggttgccacaaggatctccgtcttaccgttacggaagctgcccatgacccggtcacgctggatctgctttaaatctccatgaagtccttccgcaaagtatccccgtccctgaagagcctgtacaagctcgtctacctgcttcttggtgttgcagaaggcaacagacagctttggagcatacatgtcaaggagacggcacataacctctaccttgctctttggctttacctcataataatactgggtcacctttggaacagtcagctccttcttcaccaccttaacagtcaccggatccttctggaactttctggcgatttccatgatggctgaaggcatggtagcggagaacataactgtctgcctctcctctggaagctggcttaaaatagtttccatatcctccagaaagcccatattcagcatttcatcagcttcatccatgaccaccgtatgaacatgatcgaatttcacggtctttctgcgcatatggtccatcacgcgtcccggagttccaatgataatctgggtgccgtctttcaaagaacgaatctgttttacaatatcctgtcccccgtaaatgggaacaaccttaacaccatgcatatattttgcaagcctgcggatttcatctgccacctgaatggcaagctctctggtaggacagagggcaaccgcctgaagctttttcaccttagggtcaactttctgtaacagagggataccaaaggctgccgtttttccggttcctgtctgagcctggccaataatatccctgccctctgcctggaccggaatggcctgggcctgaatgggggatgcctcttcaaatcccatatccgctactgcccgcagaattctttcatctaactgtaattcatcaaatctaactgtttccataaatgcttgatcctttcttacggccaaccgggttcccatgttgccgtcggcctcgcacacacttttcgcaaacaaaacgagaggtagcaggcacgtttcagaccttcatcctctcgcttcacacaaatgtatattatagcagagttctttttgagtgtcaagggacatggttttaattttttatgtttttttacattcagtaaaatttataatctttgctttctatttctttagccacccgttcttattaaaataccatatctctcccaggaggatcaaaatgctggctcccacacagaccagatagccataatcccagttaagctccggcatgtttttaaaattcatgccataccagccggcaatcagcgtaaggggcatgaaaatggcggtcaccatggtgagaaaggacagcgcatggttctgcttcatatccatgtgtacctggtacatttcccgtatctgcagcgcatattctctcagctccttcccgtactccgagagtcttgacatacggccggaaaacaggtggaacaaggcacattcctcatcctttaacaggccattgtaattttctgtcagggtctggctgatattcaaaagctggccataataggaggatatccttgccagctcctttctcgcctttagtatagctcctggaacatcgctccggtctcttctgccgctcatgatccggtcttccatttctcccagccgctcctcatacttctgcaaaaattcaatctcatctcttacctgatactccaggaattcaaaaagtatatgggagacacaggttttatcaaagatctggatccgttccatctcatgaagcattctttccgcttctccgctgttatcaatgaatatgagccggttccggtccatgtaatagccaaatacagcaggcctgcctaaaagctcctttttaataggaataacaagggttcctatggcacagtcctttaataagtctgctctgcagtactgggccttttctaagtttctcatcagcagatgatcctcatacctggtatgataggttttccagtattcttccttagtcatgatctccacaagagcttctccttcgggaatcatctcatccgctcccacaggaaccagccttttctttaatctgtaacgcacgttcctttcctcctgcctccacatatttgtgaaactgatatgccgtcttaactccagccctgccagccgacccttttctcctgtttcattccagtctttccaaatatcaataattttttacagtactgatatgacttacctaacaggagcaatcacctgtccaacacccgtaagcttcctctacacaataaaacaggcctctccggcgaaaaaccggggctttcacccatgcttcaccaaaaaggcctgttcttataaaaagcttcccattctgattattcaccatacagctggtgcacgatctgtgcaatcagctttgcggttcccgtgactccaagaagggaagagtcgatcatcagattcttatgctccggatcacctggaaggtaaccggcgtatttcttatgataggcatttctggccctgtcaacagacgcgatcatccgctttgcctcaccctcagtcatgccaagagcgttcacacagttttccagccttttttcataaggtgcatagatgaaaatgttgatgttgttcttttctttttccagtaagtaatcggagcaccttcctaccaggatgcagctggtccttcttgccagatccagaataatgcccttttgcacatcaaagataatatcctgtatatatgcctcgtccgttcccaacggaaacatccggggcaaaaagctctgctttgatttttcttcttcatcgctgaccgtggaaaccggcaggttcagctgctttgcaacctcctccacaatatcacgatcatagaattccaccccagctctctggacagctctttggcgatggaacgccccaggcttccgaattcccgggtaatggtaattgtaaactttttcatagcaagatgttcctccctaactggttacaattgttttttgatatcccctcaccgcacagctgagggcaaagcagatagtaaaatagcagagcgcttcgaaagcaaacagcatcagcatgcctcttgcatcataaatgcttccaaggacaacggagcagtttctcataaactccgccacatccaccatttttaagaaggaagtgtccttaataatggtgattacctgactgagcagggcaggaatgacctttttatacgtctgtggaagcacgatataaataagagtctgtgcaaagctgaatccctgggactgggcgccttcaaactgtccctttggaatggagtttaagcccccgcggaatatttcagccataactgctgaggtaaaaagggaaatcgcaaataccgatactccaaccttattccccttcacagtaaaatagatccaaagtatccacaaaagattgggggtacagcggaaaaattccgtataagcggccacgatccctcccgcccatttccactttccggtggaataggtcctgatgagcgccaggatggttccgaaaaacatactgatgactgtggcaaaaacggcgatcatcaccgtcatcctcaaccctttcagcatgaataatacattagcctgtgtaaatatctggtgaaataattctaacatgctgcctcctcatctgcctgaagatcaagcgtttttgctatgggcagccgcatggatctgatctctaaatagcgggccagccttgccagagggaaacagatgataaaatacataagagcactggtaaaatacgcctgggcaaaatatcccctgtcagcgccccaggaatccgtaaagtacattaaatccataccggccaccatagccaggatggaggtgttcttcaccagattcagcgcctgatttgcaaggggaggcatgatgatctttatggtctgcggcaggatgatatgatacatggtttccagataggaaaagccctgagatgaagctgcctcggactggccctttggtatggcttcgattccggtccttatgacctccgatatataggcgccgtgataaacacccactccgatcactcccagaacgaacttggggatccggaagcctgaactggaaaataacatgggcagtacggaataatagcacatcacctgcaaagccagaggcgtattctgtatgaattccacatatattcgtgaaattatcttaagcagcttaaatttagccgaagaaaacataccaaatatcactccaagggccagcgcaacggccagccccaccagtgatattttaagcgtcataagaaagccaggtatataatattcaggaaatgcctgaaacagggcattccatcgttttgcatcaaaaagaccttttatcatatcatctatcctttacataaggtttactgcaatccccactggtcctgaagagccataagggaaccgtcggaaagcatggtagtaatcttttcatcaacaagggcagcaaggccttcgttctcctttgcagccgctacgccgtaatcctgctctgcaaaacggtcctgtaagatctgatttccgtcatttacataacctgctaaaatagcacggtctacggagaagcagtcgatctgcttggttgccagcgcctgagccagtgcgggataaccgtcaaactcctggaactgtgggtttactttcaatcctttttcatcaacatatttcttaaagccgtcctttgttgtagaagactgggctacgccgataatctttccatccagatcttcgatggagctgattccggaatctttattaaccagaagtcctactgcatcggtataatatggagtagagaagttataagtctcttttctttccggtgtaatggtaaaggtagcaataaccagatcgatctctccgttctctaagagaggtcctcttgtcttagcggttacaccctggaattccaccagcttcttttcctttgcctcatctgcggtacagccgaaaatggagccggcgatctcataagccaggtcatcctcaaagccttcgtattctccggttgccgtattctgtaagctgaactttggaatatcagccttacagccaacctttaaaactccgcggtcaataattttctgtacgtctgcggttacgtttccgcctgctgcctctgtagaaccagctgccgtagttccttcagccgttgtctctgccggggccgccgtcgtggtttccgtggtccctccgccgcatgcggttaaggatgccacagttgcaaaagccagtgccagtgataacattttcttcatcataattggttcctcctcatcttataattatcttaaacatcatcctaatgaaggattttgcttagaaacgctttggtccgctcatgctccggacattcgaaaaagtgttccggtgttccttcttccagaatgtaccctccatccatgaagatcacccggtctgccacctggcgggcaaaacccatttcatgagtcacacagatcatggtgatattttcatgagccagctccaccataacatttaaaacctcctgaaccatttcaggatccagtgctgaggtcggttcgtcaaagagtatcaggggctgtttggtgcataaagccctggctatggccaccctctgctgctgcccgccggaaagctggatcggataattccccgctttttcctttaagcctacccgttccagacatttaatggcgtttttctttgcctcttccttgggaacatgctgcagcttgattggtgcaagagtgagattttctaagacagtgagatggggatacaaattaaactgctgaaaaaccatggaagaatattttttagccatttccaaatggttctttttggtcacttccgttcctgccacgattatttttccgctggtgggttcctcaaggtagttgatgcagcggataaaagtggactttcctgagccggagggtccgatgattaccagtttctcgccctcctttaccgtcaggcttatatcctttaaaacctctaaatctccgaagttcttttttaagttctcaactttcaccatatctggcataattccatcccctctctgtaaattttttccgtaaatatgcaaaaagacgccttagattctgaatttcttaagcgtctttgcttagtctttttaattgttgttattataaaaagttttatttgaaaagtcaaggattattttctttttaccctatgagaggcaggcaggagcaggctacaaaatgtccgggagagacctcttccatctccggaaccttgctgctgcactcttcctgggcatacatgcatctggtgtgaaaatgacagcctgagggcacatgcatggggcttggaagctctccatgaagcatctgccgctttgactttgcggaaagctccggatcagccacagggatggcggaaagcagcgcttttgtataaggatgaaggggattttcatacagttcatcgctgtctgcgatctccaccagcctgccaagatacataacgccgatcctggtggaaatatgccgcaccatggataaatcatgagccacaaacaagtaggtaagtcccatttcctcctgcaagtcctccagcatgtttactacctgggcctgaatggaaacatccagggctgaaataggctcgtcacagagcaaaaattccggttccactgccaatgccctggcaattccgatcctctggcgctgtcctccggaaaactcataggcgtacttgtacatatcatctgacttcattcccacctttttaagcatctcttcgatcctgccgtccatttcactggccgccatgccggacactgccgtcatggactccccaatgatttcccgcacattgtggtggggatccagagcagaatagggatcctggaaaatgatctgcatctgacggtggatggggagcaattttttcccctttactccggtgatgtcctgacccttaaacagaatggtcccgctggtgggatcgtacatgcggattaaggtccgccctaaagtggattttccgcagccggattcccctaccagcccaaaagtctctcccttccggatggtaaggttcacccgtccactgcctttacttctgcctttttccggccgaaaaagtccttggcaggaaaatatttacagacctccctggcttccagcaggatttcctggttcctgttctccatatcactccaccttcctttccctggcatcaagctcttctgccgaaaagatgcacatggccctctgggtgtccgagtatacccggtactttggaatccccttctcacattgttcacaggcaaatttacaccgttctgcaaaaggacatccatccggcggatctaccagggacggggccattcccggaatgggcctgtcacctgcctggggtttggggatcgcctggagaagcgccctggtatagggatgctttggtgcgtaaaagatttctccggtcagcccctcttccatcagaagcccgccgtacataaccaggatccggtggcttaaactagccacgactcccagatcatgagtgatgagtatgatactcattcccgtctcatcctgcagctttttcaaaagctccaggatctgggcctgaatggtcacatcaagtgccgtagtcggctcatctgcgatcagaagcctgggccggcagcaaagggccatggcaatcagtaccctttgcctcattcctccggaaaattcgtgaggatactggttcagcctcttttcaggggacgggatgcccacctgttctaaaacagcgatcgcctctttttcagccgcccgtttatccattcccctgtggcgtttcagtacttctgtcagatgaaagcctatggtcctgacaggattcagtgctgtcataggatcctggaagatcatggcgatctcttttcccctcatctttcgcagctgttccggcgtcaatttaagtatatccttatccataaacatgatttggtccgcattgacctctgcattctccggcatcaggcccaggatggatttcatcagaacactttttccgctgcctgattctcccacaacagccaggatctcctgatggcctgcgtgaaagctcactcctctcacagccttaactgattttccgtgggtatgaaaggtggtatggacattttgggcggacaggatcttatcatcatttttcttagtctcttccaattcctgtttcctcgctttactctttctcgtcattcataattttaggttccacgaaaacccggagcagatttcccagtttattaaaagcaaaaatcgttattatgatcagaaggcccgggatcagtgccatgtaaaaggtgttctgcatggttccctgggcgttttgcaaaaggcttccccaggaagacattggctgctggattcccactcccagaaagcttaaggaagactccgtcataattgcatttgccatgctggtggttgctgacacaataattgtgggaaatacggaaggtatgatatggctggtaatgatcttccagatgcccacccctgaaaatccggcatacaggataaattccctttccttgagagaaagggtctcagccctcaccagcctggcaatctccatccaggtaaaaaagccgatgaccagaatgatggattttaatcccggctttaaaaagatgctgacaacagtgaccaggatcatccatgggattgaatacaagacatccacgattcgcatgagtatcatgtccaccattccgccgcagaaaccggaaacagtgcccactgccaccccaatggtaaggcttgtgagcattgccaggaatccgaccagcagggaaacccggcctccgtagatgacccgggcaaaataatcccttccgacttcatcggtcccgaaccagtgcccggcagacggcggctgaaggcggcttgcaatattggttgcatttggttccacaggaagaaaaggtgcaatcaatgcaaataaaataatcagtcccagaagaatcagggaaatgaccgccgccttatcatgttttaatgaaagcaatacactgtccactctgacggatctgcttttctttgtgttcttttcgtttcttttcatcttctgtcaccccatttccctgatgcgtggatccgtaatgcaataaaggatatccgacagcaggtttccaagaattacaagggttgaggacagtaccagaatgatcatgacaatggggtaatccatgccctgaatcgccttgataaaataaggtcctatcccaggccagccaaatacggtctcagttatgatagccccagtcaccagcagctgaagtgccagcccaagccttgtaataatgggaagcagaacattcttacagacatgcttgaacatgatttcccctttagaagctccaaaggcccgctgaaccagcacatagtcttcagaaaactgagtgacagtggaggaacggacaaattttaaattagccggcaaaaaagaaaagacaagggtggtaaaaggcatgatataatgccttaaaaagtcaaccacggaagcttcctttcctacggagtgcatgcccacaataggaagaagcttcagcttatacccaaggataaaaatcaaaagcatggaaaaccagaaggaaggaacggcgatcgcaatggaagagatcccgtcaatcaccttgtctgctgccttgttcttgtgggagcctgccaaaagtccaaggatgattgccaggatataagcgacagcataagccggaagcaccagctttatggtgttggggattctcaccgcaaggtctcctgcaatgctttgcttggtcacgatggaatatccgaaattgccgtttaatattccgttcagccagctgaaatactggataaacagaggcttgtcatacccatattttgccttaatcaattcaattgtttcctgtgacatccttggtgttgtcattgcgtcaatggcatcatagggtgcaaaatgcatcaaagcaaaacatagaattgtgatcagaaggatcatgggtacggctgtcaatattcgtcttactatatatttcgccatatggtttctccttaataataagaaagaggtgcctgctgccggaatcctgcagcagaacaccctctacttttcacagctgctccttgccgcaccatttctgcagcttacacacctgctgtctgcattatttcatctgcagtttggaagtatcttcaaaggtataaacaggaaccagctttgcatcctcaattcctgatacgtctttggatactacaagaaggcgcttattggaatacagcggatagaagcaagcggtatcctgcagcttctgctggatggttgtatagatttctttacgctttgcctcatccgtttccttccggccctgagcaaaaagctcattgatctcaggatagtcataatgcatgtaattgtatgaggcgcctgtttcaaataagcttgaaaacgtatccggatcaatgcccataatatagccgccaaagtacatatcataagaattgtcagcctgcttcatctgctggcttaaggcggtggaatccacgccggttaagttcaccttaatgcctgccttctgaagctgctcctgtatcatgatggcagaagtggactgaaggctgtcagaagcgttataagcaagtgtcaattctggatttgttacgccggaagctgcaagaaactccttggatttatccagattctgttcatatttctccacatcctcggtgaaaaactggctgttgggaggcatgaagctccatggcaaatcataatactggggatccagaagagctgcatctgcaatggcacttttatccagggcaaagagaatcgcttttctgaggttctcatcctttacacgggctgcattgatcatcatatatcccacacggccttcctggtatggataaaccgttaaattagctgcttccagattcatctgcgcaacctgggccggagttccgatccaggcatttacttccccgctctgaatggctgtcatggcagtattttcattttcaatgatcctgtatacgaaattgtcaatggacggagcgcccaggaagtaactttcattcttagtaaacttcacataggagcctggggagtactctgccattacataaggccctgttcccacgggcttggtgttcacatcattgttttcaaagttctccacattttcatagacatgctttggcatgatgaatatctgggaaaacatctctaccgctgcggaattgacaaaaggcatggtaagggctaccgtatagtcgtcgatcttttcgatttttaccgctccttcagggaaaaccagctgagaatatgcccagcctgcgtttttctcatcttccattgcctcaaaggtaaagacaacgtcatcggctgtgaatttctctccatccgaccattttacatcatcccttaagtgcatggtataggtcagcttgtcatcagaagtatctatgctctttgcaaggaaataattgattccatcggcattatacatatacagaggagaatagatcattttaatggtcataaggccaaaacggtcgcttgtggtgatcacattcacattggctcccggatcacctgcaatggcataggtaaatgtactctcacccccttctgccgtattaccggccccatcacttgattcgcctgctgaactggagttggcagccgtagtaccctctgcaaccggatcctttcctccgcaggcagtcagccctccaagcaccatgacagatgcaagcaggaaagccgcacttttcataaaaacctttttcataaatatctcctttcagttctccattaataataacccacatcacatgtggttatctttcagaaaagtcagatttattataaacacatttctgatctttttgcaactgttttcggatcatttcctagtttttctatatgtttttaggtgatggcctcttttgcggaaaatgagcctcacaatcttaaccgctgatggattcgatcctcttgtcatttgaccacttgatgattaagtcatttttcccatatcccgccggataaagaaggtccagctccaccttggcgcaatccttcgctttccccactttcatgtttaaaaccttgatcttttcctcgtttaaatcagaaatcagctcctctataaggctgtcatactggctggttgtgatctttaaaacgcttcggtacggctccctggaaagaaaggggacgtcatgaaggatgatctgggtaaaaataagaaaaaaccctgcaccgcaccccatataataggcgcctgcaccgatggccatacccactcccgcagtcgcccagatgcctgccgcagtggtcagaccgctgaccgaatgattcttaacaaaaatcacacctgctcccagaaatccgattcctgatacgatctgggaagcgatcctggatgcatcaaaattcggtacatcgcgaaatccatatttggaaaccaccatcataagagccgcccccatggccacaatggcatgggttctcattccggctgatttataatgattcttcctctcatatccgatcagacaccctaaaaatcccgccacaacaattctgaaaaacaaacccgtctggtaaataaggtcataccgttccacaaggctgaccagcatttcccaagtctggcccatgatgattcctcttttctaaatattaattcatgtcttataaaatatgcttgggattcatcatgttgcgtaaaagggcctgcagggaactgcctgtccgggccggttcaacttccctgcctgtttaaaaaaagctgcattacaataaagaccggaaaaagacagaagcggcctgttttatcctaaataaaactgcacgcgttccatctctttccggcctttagcgaaagggtatgtgattattttacttccttgatccagttatatctgggatcatccgtccgtgtggtccagggattgcccggaaggtggcggatcatccagcagtagtacatgggaaatccaggtgctgtcacctgggggtgggtcctgccgccgggaatggcagcacagcttccatccttgattttaaaggcctcttccccaataaagcaggccccaaagccctcaggccgctcaaagcggtaataatagacctcaggctgaggatgatcatgaggggtgtagctggaccagccgccctggtgattgatgacttctccgtttaccatattggaataaggagcgtttccatagtcaaagatggtgcggacggtccgcttcatcttgttttcccaaagcccttccccaaaaatatcattggtgcagtcctccggcctgtagaaaacgctgtcaaacgtcctgtcatttttcgtggactgaaccagcacctgactgtcttcctttgccttcacgttcaccgaaactccctttgaaacgtgaaggcagtacggcccttcctccatcaggctgcttcgttttccccattcctccctttcttcccaggaaaaccggatctctccggtgaggagaaggactgccatctcatccgaccggctggagaaggaaagttcctcccctgccttcatctggtaaacggcaatgtccatcaacatatcattttccccatcccccgcttttgtcagggtctttactcctttgggatcaaactccggataactgaatatttcgctcatggcagctcctttctcctccttttatttcttacatcatgatctcagaaatcttcacaggcctgtgctcctgcacggactttttggctgcgatccccattaatacaggctttaatccgtcttccacaccaagaggggtaggagtatcattctcaatggcctcaatgaagcagttcacttcctttgcaaaggactgcatatagcgctctaagaagaaataaaggggcttttcacttctaactccatcggcggtgctcaccactgcgctggactcggtatcattggcggttgctaccatgcccttggacccaaatacctctgccctctggtcatagccgtaagcggcttttctggaattatcaatgactgccaggcttccgttctccatctttaaggtgatgacagccgtatccacatctccggcttctccaatggcaggatccactaaaacagcggactgaacgtaaatttcctctgcatcgcagcctgctaagtagcggaccatatcaaaatcatggatggtcatgtctaagaacatgccgccggatactgccgcatattctgcgctgggcggctccggatctctggaagttactttaatgatgtgaggctcgccgatttttccggctgcaactgcatttctcaccgcctcaaaattatggtcaaaacggcggttaaagcctacctgatatttcaccttactgctctttaatgcttccataacctctttgatcttctcaatgtcgtgatcaatgggtttttcacaaaatacatgctttcccgcctgaatggcctcaacggaaatgggggaatgggtgttggtggatgagcagatcaacacggcgtcgatctccgggtctgctaaaatttccttgtaatcctttgtggtattgggaactcccatgccttttgcccatttttctgtttcctcattcataaacggatcggcaatggttttgatctttccgttctttaccaggttacagatgctggtggtatgtacttttccgattcttcctgctccaataattcctactgttaccataatatcttctcctctctctttcttcctcttaaaggccggtcttttcggcaatgaatttccttgcgcagatggcatattccagtggattcgcctttgcaggatcctgctctgcttccactaccatgtatccctcataagaagcttcctcaagcaccttaaaaatcggatcaaagtcaatgcagccgtctcccggaatggtgaaagcccccgcccggacccctgccaggaagctcatcttttcttctcttaccctttttacgatttcagggcggatgtcttttaaatgtacatgcttgatacgtcccacatatttttccaccattgccaccggatcctcgccgcagtatgcaaaatggccgctgtcaaagaggaggctcacatattccggatcagttccggccatcatgcgttccacttccgctgcactctggacaacggttcccatatggtgatggaaggttaaagccactccgtatttttccttggaaagctttccaaggcggtttaagccctcacacaacagattccattccctgtcatccatttcatgttttccttcaaacaccggctgatcctggattccctgggtgctgtagctctgctcggaaacacctaccaccctggctcccatggctgccaggaacaccacatgcttttcaaattcttcttccgtctcctcataaggtttgctgatcaaaaaggtggaaaaccaggcgttgcagatctctacgccccgaaactccaatgccttttttaatgtttccacatctcttggatatttgttgcccacctcggaaccggtaaatcctgccagagccatttcgctgacacactgttcaaaggtgttttccttccccagatccggcaaatcatcgttggtccatgcgatcggtgcgattcctaatttcactttctccttgtttaacatgtttgaatccccctgtcaaataaaatattttttataccgccgtttttcctgcgggtcgccatattaatactttctggcttcatttcttccttccatgaccttttcccacgcttctctcacgctgctcttttctgaggtcgcggcaagtcctacgttccaccaggattcatacccatccgacatggtcttggggatcacctttaaatcaaacaggcaggccctttcctgtgttttggcatcttccagagcctcttccagttctttgatggttctgcaggtataagacttcagtccgtagccctccccgatcttggcataatcaacgggaattaaatctccggtgggctttttcccgtccgtatagcggaattccgtggcaaggcttccgattccgtggttcatttccagattattgatgcagccaaagccgcagttatcaaagatcagaatattgaccttctgcctttcctgcataatggtcatgatctcactgtggagcatctggaagctggagtcacctacaacacagtaaacttccgtttccggctctgcaaatttaacgcccagcgtggccgctacttcataccccatacaggagtacccgtactctgcatggtatccgccccgcttgtcagttgtccacatgcgctgcatacagcttggaagggaacctccggccgtaatgatggtagcatcttcatcaatgactcttctgattgctgcaagagcggcggtctgggtgatctttccattggttaagcggacaaactccggaatagttctgggatcccgcgcttttatattgggctcaaaatcatctccagtgtattcaatgctgcctaaacgcaccatctcttcatcccattttctttttgcatcaatgatctcgtttttgtactgagacacatattgtctttccttaagcttctccgccagggcctgaacggtcaccttcgcatcccctacagccttgactgcatccattttgtatgcatggaatctgctgttattgatggtgacaaatcggacatcttccttttgatacagccactttgagcttgtggtaaaatcactgagcctggtcccgatggcaattaccacatctgcatcctttgcaatcacattggaggcataggttccggtaactccgattccgccaaggcaatagggatggctcgatctacaggcgctcttccctccctgagtctctccaaagggtattttaaattcctcgcagaatttttccacggtttcccctgcatcagagtaacggactcctccgcctacaattacaagaggcttcttagcttctgcaaggatgtccgcgatctcatccagttcttcttctactgcaagaggcctggtgatccggtgtacccgcttcttaaagaagtaatccggaaaatcataggattcaccttccacatcctgacagagggaaatgcagcacgctccggtttccgccgggtccgtaagcacacgcatggcattgatcagagcgctcatgatcatttccggtctggtgatcctgtcccagtatttgcacaccggtttgaacgcatcattggtagtggttgcaagactgctgctttgctcaagctgctgcaataccgggtcaggctgtctggaggcaaaggtatccgccggaaataccagcagcggaatgttatttaccgttgcggtagcacaggctgttaccatattggccgcacccggtcccacggatgaggcgcatggaatgattttcttccggatgttctgctttgaaaatgcgatggcagcatggcacatcccctgctcatttcttccctgaagcaccttaagctgtccggggtccgaatccagagcctcacctaagccaaccgcaattccatgaccgaaaatagtaaaaacaccttcaacaaactttgtttccactccatctgcagaaacatactggttatccaggaacttcacaagtgcctgtgctgttgtcatccttattgtttttgacatgttccgctctcctttatatttttatacacgggcgatcatttcaccaaacttttccttttcttcttttataaatgcatgcacttcctcaggcgttggcagggaaaccgaacagttgttgctctttaccatcatggaggcctctgccgaaccaaactccaggcagtctatgatatcccagccctgatacagtccataaaggaagcctgaaccatatccgtcgccgccgccgaatccttttctggcctccacagggaacggtttgatggaaaatgactgtccgtcacaagtatatgcggtagaccccttcattccatgcttaatgaccacgatcctggcgtgataactctgccacagagccgcactttcttcgtccgtcattccctgtctgatcagtttttctgttaagttaaattcttctcttgagcccataatgatatcagcttctttggctactgcagagtagtaaatggatatttcatctgcatttttccagttatatgccctgtaatcaatatcaaaaatgattctgacatcgtttctctttgccagcatgaccgccttaagggctgcttctcttgacgggctttgtgcaagcgccgtgcctgatatcaaaattgcttttgtcttcttaatatacgcttcgtctatgtcttctacgtccagctgtaagtcagcaatgcagttccggtacatcaggatattgctgtcactggaagaaagcatttctgtaaaggtcagtcccagcttttctccatttttgcattttgtaatatgagaagtatcgatcccctgttcgttgaaataatccactacaaattcaccgaactggtcatcggatactttcccgataaatcctgccttcatgccatgtcttgtcacgcctacggcgatattagccggagagccgcccacaaatttttcaaacatgtgcactttctttaagggcttgaattcttctttcacatactcattgtaagccggattgaaatcaattgccacccttccaagaagaattaagtccatttctctggtttcatcaaattttacatattccatcgctgcatccctcccattggttttgcgtgtctttgttcttaattttctcccggtgagccctgttcctcattgaatttttccggttggtttttgaatcccgctcccgtcatttctcttatattatatcagattgacagccatttcatagcgcgaaaaaacacactgcaaggtttatttcaccttgcagggcgtttttatccatcattggccggtatcttttagatcgtaccatcccaggtgttcacgtttgtggattctccggtttcttcgtcgaaccacctgctggtgacaactttgttttctgtgaagaatcggtatccatccttgcctaagcagtgcagatctccaatgaatgacaatttcttgccgttaaaaggaaacatgcccaccggaaccggaatccccacattgataccgatcataccgccgtccgtatgtctggcaaactctctggcatagtgaccgctttgagtaaagataacagaaccgtttgcatatggattggcattcatgatctccaatccctcttcaaaggtctttactctcttaatgcacagcaccggtccgaagatttctttttcccctatgctcatgtcaggagttacatggtcaaagatcgtcggtcctaaataaaagccgttttcataaccttccactacaatgtcgcgtccatccagtacaagctctgcgccttcttctattcctgtctcaatccactttacgatggactccctatgagccttatttaccaccgggcccagttttgtactcttatcataagcgggtcccactttaagagtcttggcctgagcgatgatctccgcaacaagagcatcggcaattccctcctgtaccactacaacaggcagagccatgcaccgttctcctgcgcatccgaaagaagaattgatgatacccgccgctacacgcttgaccggagcatcatttaaaaccagggcatgattcttggcttcgcagagagcctgaactctcttgcccgttgccgcagctgtggaatagatatgcatacccacagaagtagagcccacgaagctgatccctttgatatcaggatgagtgagaagaatctctgcttcttttctggagcaggtaacaatattaataactccgtccggcagtcctgcttctttatacagttctgctatacgcatacaggactgaggggtaaaggatgctgctttaagcacgatggtattgccgcaggcaatacacatgggagccatccaacccatagggatcatagcagggaaattaaacggcacgataccggcaaatactcctaaaggcattcggtacagcaccgtatcaaatccggcagaagcgtccatcaggctttctcccatcatcagtgaaggggcactgatagcctgttcggttccttctttggctttcagtacatcgccctgagcctcttcccagcttttaccgttttcctttgccaccagcatggtcagttcgtccatatgctcgatgagcaaatctctgagcttatagagtacctgaactcttttaatcacaggggtagatgaccaggacggaaacgccgctttcgctgcctccacagcctcctccacttctgccggagtacagcatggaacctgggcaattacttcaccggtactgggatcataggcatcagaatacttatctgtcattgattccttccactgaccatttacaagatactttaatttttttacttctcccatttttatatccattcctttctcttcgcttaagacataatacgttatgaaaaacagatgctttaagcggtttttattttttaattttatacatggaacccggtacactccacttcatgaaaagcaggcgggttatccggctctcggacaaccgtatctttctatatgcagtccgcctttttaagcataaatacgagtgcttcgggtaagtaaccttattgtcaatccggcaagttccggttccggcaaatatatcgtggccggcagttttcctttattccgtcatgtaatcgtttcattacatcatactgatttatgtaagcggctccacacattgaaagatccggatatgctgcttcacattctcatacactccccggaccatagcttcattcagcccgaaataatcatgttttccttctgattccagatactttccagcttcctttgtaagactgtcaaagctggctgttgcaatgttaatcttccggattccaaggcctatggctttccggaagtcctccggggtgattccggttccgccgtgaaggaccagaggcacagcaatcttctgatcaatcgcttccagaacgtcaaaagccagtctgggagccaccggataattgccgtgggcattaccgatggcgactgccagtgcatccacgccggttctctggcaaaatgttctggcatcgtcaggatttgtacagcggattccctcatcaatgctcccatcctcgctgccgcccaccaggccaagttctgcttctacggtcgctccgtattccctggcgagattgaccgcttccagggtctttgttatattttcttcaaagggaagggtggaaccatccatcattacggaagtgaacccataatccagagcctgttttaacacctcaatggacttgccatggtccagatgaaccgcaatatccacctttgcaatctttgctgcttccaccatcataggccccatcagagtcagcggggaatggtgcagacgtacttctgcgatctgtaagataatgggtactttcatttcttcagctgcttttacagctcccttcaccatctcaaggtttcccacactgaaagctccaaccgccagattatcttctgaggcctgtttcagcaattccttcatttttactaatcccataccttttctcctttatccggcttttcaatcccgcatgctgggaaaatctccgccatattattccttctcaccccgtcaactcttttctgacaatgaaaaacttttcccttttcagtgccgtaagaaaatcacatctctccttcttgcagctatccgctccggcggcgatcatggtatcttcaggctcgttcctgaatccaccgccattttatcagtgacagcaagagcatttatcttctgttcactttatggtgatatgttgattctatttgtgttatcttttggtcatattctaccattcatttaaaaattagtcaagaaaatcttttgtatttttacttaatttgatcatatcttggttgcttcttgatattttctaatgtatctgttataatttcaccagaacagcatgccaaaaagctgccaagtaaggagtacacctatgagaatttcccgaatcgatcaactggaacaatatatattggagcacaaggcggcctccattgatgccctgtgtgaagaatttgagatttcaaaaaacaccctgcgacgggacttggagatcctagtctcaaggggcaccgtggagaaggtttacggaggtgtggtcgcatgtgaaaatacggcagccatcccaagtctgatcaacttccatgaacgtgccggaaaaaatgcccaaagcaagcaaaagatcgctgcactggccgcttcctttgtacgggagcgggatatcatattcattgacagcggaaccaccaccatgaatattgtggatcacctggcccatttaaactcggttacggtcattaccaacagcctccaggtcatcaacaagtccatgagttacccaaacatcaatgtgatcgcccttcccggatctttaaaaagagataccgcctcactggtgggcagttcctgtgtggaatatttggaggattataacattgtccgggcatttatggcctgtacagggctctccgcccaggctggagtctgcaacgcttccacagaggagtacaccattaagaaaacggcattaaaaaagagccagaagcattatcttctggcagattcctcgaagtttgggcgcacctctctcatgacctttggagagatcaggcagtttgattatatcctgacagaccggctgcctgatgatgccttctgttcctactgcagagagttgggctgcgccatagagacggcacctgagcaataggaaaggcgtatcccggagtttcttcctgaacggactcctggatacgccttttatattttagccttactcttatgcagttaaatcttctccaaaatgtttctaagagattcatatgccatggtaaacgcttcttccccgctcatctttttcttctgggaggaattctgctccaaagcgttaaagcctgcaaagtcacttaaatgaggttccagggataagaagccctcatacccgccggctttcagcatctttaatatctcttccacatgcccgtctcccatgcctgccggaaccacgcttgcatcggaccacagggcatcctttatatggatgtaggcgatgtagggctttaacatttcataagcttccagagtatcctgtttgcactgaacgaagttggcaaagtcaaagactgccttaaaatgctccccatagaattctttcatgatttccaggcatcggtccgccatgtctccgtaaatatccttttcattctcatggagaagcaccacacggttagcctttgcgtaatctgcaagctggcccaactgatccatgacctttccccggtatggggagtaactttcattctcaggcatgaaaaagctgaacatgcggatgaatggaacctccatctcatgggcgatttccaccgtgtgcttgtaaagctccatatgaggggcaaaatcatcggtgatctggatctttccaatgggagagcctacagaggacaaacggattccccttcctcaaggtgctttttaatttcctttacctcgctcatggaatgctctaccagtcctttcccgttgacccccgcatctccacatgatgaatttccagcttctttaatacttccatctgctttcccaaatccatatcgatttcatctgcaaaaccggataattgaattccatcccacataatcatttctccttttttatctcttaatagcttccttctgtgtcaaataccacgcctgttccttcttttttcctggattccctgcggcgcttattaagctcctccaagaataaatcctcatcaaaggggatctcaacctctctttttaaccagctggataaatgcatggcgtttgataaggtcagaccgttgatcccttccatgccttccgcgatcagaggtgtgccatgaaggatcttaccagcaaatgcctttaagacgcccacatgctgctcattttccccgtctgtatcaacctctgtcaccgtacattccggggtatcaaaaccgccctttgctgttttgcagaaggtacgctcgttttccgccagcttatgaagcaaaagcttgttattttcgcagaccagcttgcccatttccaaagtgatctcaaaccggttggttcccggagcatctgcagttgtggtgacaaagactcctgtggcgccgtttggatattccatataagccgttacatcatcttccacttcaatgtcatgccatttcccgttgtggcagaaggcctgtaccttgcttggcattccgcagatccactggagcaaatccatgttgtgagggcactggtttaataaaacgccgccgccttctccctcccaggtggctctccagcttcctgagtcataataggactgggtgcggtaccagtctgtcacgatccagttcacccgtttgatggcgcccagctctccgcctgttacaagctcatgcattttccggtaaatgcagttggtcctctgattgaacatcatggcaaagatcctgtcgctctttttggccgcttcgttcatttcccggacctgctttgtataaactcccgcaggcttttcacacatcacatgaagcccgtggttcatggcatcaatggtcagctccggatgctggtaatgaggcactgcgatcaggactgcgtcacacacacctgctgcgatcagatcctttccttcctcaaagacagcaaccgattccggcaacttctcctttgcccatactctcctgacttcctggcggtctgccacggcagtcacttccatctcaggaaccttaccctccagaatgttctttaaatggccggttcccatgtttccaattccgataataccaagtcttaccttatccatgtcttatctcccctcatttcttgcagaatcataaatatccatcatggtgtaaaatgtattctgaaccgaggctatgtcattgaaatagtccctcccggtatccagacaatcataaaagtccctgatacaggcttcatggccgtttccccaataggtttttcccagaagggagctctttttcgcctgccagactacaggctcctcctgctcctttgtctgataccagacagaatttccttccaggcggacgaacccgttctcacaggcaagctctaagaaaaccggtgcatccacggcgtaagcagttgttgcataaaagctggcacttaccggttcttcagcctctgtaaaggtcatatacgcttccagggtgtcctccacctcaacaatcccctttaagtggtggttattcatggccgcttccgttttcacaggctttccaagccaggataaaagtaagtccagagcgtggatagactggttgatcaatgccctccgccttctgtctcaagctttcccctccagccgctttctgtgtaatagggcgcatccctgtgccaggtcacaaaggcccttccgccttttatcctgccaagcattccctgggctaaaagctcatttaccttttttgtggtttcattataccggttctggaagcagatacccaacctgcccctgctttggtctgaaacccttaaaagctcattaaactgttccctgcttattgcaggcggcttttccatgaacacgtgaaggcccttttttaaagcatctgaggccatgggcacatggcagtgatgaggagtgcagatatggaccacatccagttcttccttttcaagcatttcttccatggatccataggcctttgcctttcttcctgtaaaacgggctgaatattcctccgcccgctccagccggttatctgccaaagcgcagaggctgacctcttctatttcattcagtaccatggcatgaactcccccgatgtttccgcagccgattatcccaacccgaaccatgattacctcctcttttcttttccttctttttgtggtaaattaattatatactgtttttaacgcaatttgtttgcgcagattgagaagaagtatgcgcagattgtctacttcaggaggacctcatgaataaggaaacgccataccattacagtgaattttccgaacccttcagctgtgactttactaccagccatatggccggaaacgtggattttcacatgcataacagccatgaaatctacttgctcatagacggccatatccagtactttgtagaaaacgtctgctatgatatgagcccgggaagcttgatcctgttttccaaccgggagattcacaaggccatcaataccacaaaccaagcctttacccgcctggtcattcacgtgaaccccgcctttatccgcccctactccactcctgacaccaatcttttggactgctttcaccgtgagcctgccaaagggaatctggtcctgctttcaaaggaggaatatggcaacctggtttccatggcccagggccttcatgaggcaataaaaaaccgctgcacttacggcagcgatttaacggcaatgaccacattgctccagatcctgattctcattaataaagcctggcaaaagacaagctcagcaaggacggctccaaagcctcaccgggcacaggcgattatgagttatattgacaagaatttaacaactcccatgaccctggattccatatcccaggctctttcccttgataaatattatatcagccacttattcaagtcagagaccgaaagcagtatctttcagtacattgtggtaaagcgggtggcactggcaaaagatctgctgtctcagggatatacagtttcagaggcctgccatttgtcaggctttcatgattattccaacttcatccgcaccttccgccagactacgggctatacgccgggacagtttaagcggttgagccggtaaacctaccgctgcttataggcaggatctgccggatatgcgccccggatcttttgcatcccgcgctgcagggcgtcctttgactgcttccaatccgcatccttgtttaagtaatcaaacttctcaatgaaccagtcgatatcaccggatatccgctccatattttcctccatgagcttgaaaattacgggatagaactccttccgttccctgtcatttaaatgctcatcagcccggctgcacaaatctgcaaaatggtggaggcagaatcccttactcgtttcaagcttttcccggaaggcaggatcctttttgtacaaatagaaaaaggtcgcaacataccgctcatagatttccgaaaaccggtcgcatatatagcaggtctttgtcttttcctggatccaggtactgacggaattgcggtttccccttttcctgtaagccggtcctttaaggaggtctttccgggaacaaactccttaaattcctcactcatttcttttatcagctttttataataggtttttaatatccagccatttcccagggcattgccgtaatcaaacatcttcttctgatggatacggcagaagcctgaccggtctgtggcctctcttgtatcactttccatataagaggcacaggaacctaacacaaaatccataagctcctgttctgcttttctctcaagaaagcagaacaggcactcgtcatctgcatccatggcgtcgtttaagggtatttcgtatagtttttctttcatctcttataccttagatcggtactgcataagctgttccctgtttaactacttttatagccattatcggagagtttacgtaccttgccctttcatttgtggtagtacggacgttccattctaccatgagaaaaagtcaaaaaatcacttggttaatttcatagacacccctattatactgcgatataatggatatgctgtcaactctttccagcaggaaggaggtgtctgcatggaattcttaactactttcattcattctgtcgcggcaagtgtagctggctactacatatgcaaatggttagacagaaaacataaaggcagctaacctaaaatgaaatcccgcgcactggcatacgcgggatttctctttgtgaccacatggtcttaactactttcttagctactgttatattacaccattttgggtgtattgtcaagtttacaccttaaaccggtacccaactccccaaatcgtctcaatatactgaggcttggccgtattaaactcaattttttccctgatcttcttaatatgaacggtaaccgtggcaatatccccgatggattccatatcccatattttattaaacagctcttccttggtaaatacatggtttggattctgggcaaggaatgttaaaaggtcaaattccttggtggtaaagttcttttcctctccgttgatccatacccgcctggctgttttatctattttaagaccccggatctcaatgatttcattgtcaggaactccgcttccgatcagcctttcataacgtgccagatgggccttcacccgggccaccatctcactggggctgaatggctttgtaatgtaatcatcagcacctaagcctaatccccggatcttatcgatatcttccttcttggcagaaaccataataatgggggtgttttttacctccctgaccttccggcaaatctcaaagccatccactccaggcagcatcagatccagaatcaacagatcaaaatcctcatggagcgccatttgaagtccttctccaccgtcattctcgatctcaacctcaaatccgctcagctccagatagtctttctccagctctgctatgctctcttcgtcttctacaatcagtattctgctcattcctgtatgacctcctgatattttctcaaaacaaaatgtatctccgttccaatgccttccttgctggtggcccagatccggcctccatgatcctcaataatcttcttaacgatggataagccgatcccgcttccgccctgagaagaatttctggaggaatctgtccggtaaaaccggtcaaaaatgctgggcagatcctttgccgggatccctcttccgttgtcctcgatctccacctggataaagtctcccacatccttgatccggatgttgataattccgctccttttatccatatatttcacagaattgctgacgatgttattgatgacacggcgcagctgctctgcgtctgcaatgaccaccacatcttcatccacataattaaaatatcccagttcaatgctccggtcttccatttcaagtccaacttcatccacgcagtccctgaaatagcctgccacattgatcttggaaaaggtataaggaatcttattggtgtcgatttttgaataaaaggtcaattcatcgatcagtttgtccatgtcattggccttgttgtaaatggtgcggatatagcggtccagcttttccggagaggaagccactccatccatgatcccctccacataccccttaatagcggtgatcggggtttttaaatcatgggatatattgctgatcagctccttgttctccttatcatactccactttttcctctgcggattccttaaggcggatcctcatctcttcaaaatcctggcaaagctgtccgatctcatcgtcattttccacttcaagagagaaatccagattcccatcccggatcttcttggttgcaacctggagccgccccaaggggcttaccacggaccggtacacccacatcattaagatggcatcggtaaacacgatgatcataatgattgccatgagcatttccgccatcatgaccttgatctcaggaagaaggccgtttacattggaaacaatgaacacgcttcccttgttcccgtcaggataaagaaaatccatctgctttaccagatgctgggtctctccatctaagtaaatggcgccgtcaatgttgctatccatttcctcgtatttgggaagctggccgtaaaggccctgggtgatgtggctgtttccgtcaaaaataagagaatctccctttcggacgatcatataggcatatttagataccagattctcgttaatctttgccaaataatccgtatcctgaaactgccccgggtcgctttgaaggatctggctgatttccttttgctccgacctggtcaggcggttaaatatctgcagggaattacttgaaagaaggtcgatctgctccgtcaaattataggccttccggaacgccttcatctggtaattgccaagccctgcaaccactgcaaagatcaggaccagggggattaccgttatgatcaaaaatgctacaaccagacgggttctcaattttaatttcactattctcgtctctccatgctctgaaacttcatttataacgaaaaattaatattacataggggtattataacacacatggacaagagaatttataaaacaattctaaaatttaagacattgctgctaaataacagggttttatcatagaattttccaattctgttactcttttcattaatattaaaaatgctgtatccttttcgcaataaaaggatacagcatacatgatcatttaatattttgtattcaatcataattcctttggatctactccgaaatggtcaaaaaggatcttttctgcttccccattccataatcccttatgggccttgcaggattcactgagcttcttaaacagaggatcagtctttcccagctcttcaaaatcgtcaatggctgtcaaaggcatatcaaactgggtataggtaagcttctttccaccgggtatggaaggcagattcttggtcgcctccgcgatgctgtcgatccctcccacatgggttaccataacagctgcttcaatggctccttccgcagacagctgattggcctccaccagatcatctgtattgccgccggtggtccccataatgtgggtgcttgtatagtggcagttataaaggttgatttccgccttaaactggctgtctgaagggccagcaaagaagttcatgcagccgtcaaaggccagaagcttatctcccatttccgccacttcttttactggaacatatacaaacacatcatcatagccatggccatgggtgagcgccgtcagttcagaaacaggatcagccatttttgctgtatttacataaagaagttcaattcctctctcttttgcagattcttctgaaatcacttcctttgccctggcgatcctctcatcactgatatccgtaactacgatccgctttggcttattttcaaactgaaggccatagcttaccgctcccagtcccatggggccgcagccgcccatgatcaggatgtttccatccacttttgttcccatggcatgatcataattccttttgttggtatgataattggcatggaagccgccaatgatgcagctcataggttctcctaaggaagcctcaaaaaagctctctcccgtgtattccagcaggcagcccagctccatgacctcattgggcataatgcaatacgtacatgcgcctccgcagaattcataagaatatcccggggaatccagtttccccttatagtttaaagcaggctgcagagaaaacttctgtccaggctggaattgatcctgccactttttgcccacttccacaatcagtcccgagcattcatgaccgatgatcaccggattggtatctatgttttgaggagctcttttatgcttttttccctgttttaccagcttgtaggtggacatgcagatactgtcactcatgatctttacaagaatctcatcttcatgaatctgaggaagctcaaactcttccagccttaaatcatctgtgccatacattcttaccgcttttgttatcatatttccatcctccaaccttatttatcaaattttactcctaaatttccagcagctgcacctgcttcaccagttcatctaccagactgcggtgaggcggcttggtccctatgcttgtgaccgcgcctgccgaggctcccatacataaacggatgcaggtttcaaaaggaagcttttcatcccagctgtaagccatggcagctaccagagcatctccggctcctacggtggaatgggcctttacccgaagccccggacaacggtaccgtttttccttagtcaaaaacatggcacccatctggccaagggaaatcacggtcatggctgctccatgttccaaaagcttctcccccatggaaaccagctcctgttccgaagccctgtaatccatttggtaatgccgctccagttctgagcggttgggctttaacatatcaggcgccgctttcagtgattcggaaaataacgggccgtctgcatccagcaagacctttgcacctttcctgtgagccagttccgtgatcctgcggtatatatccgtcggtatgcctgcaggtatgcttcctgccagaacaaacagggtatcaggctttgcatagccctccagccttttaagcaagtcgtttagctgctcctctgatacctcaggtccaggctcattaagctccgtcacctctcccgtttcttccaccactttcagattcgttctcgtctccccttttacttccacgaaatctgtctgaatgcttaaatcagccaaaacctgtttgatgatcgtgccgctggttcctcccacaaaaccagtggcaatgctttctccgcctaattccttaatggtcttggaaacgttgatgccctttcctccggcatccagttccacccgtttgatcctgtttaaatcccccgttcaaaccgctcaatatccacggttttatcaatggccggattcatggtaactgtaacgatcattaggaacacctctttcctgtaaacatggtatggatctcctccgcgctgcacttagtaatccggtccacatcagccggatcagcaaggcattctgcaatgacggcgagtatttctaaatgttcctcccctgcccctgcaatcccgataaccagcttcaccatttctcctccccagtctgttccgtcaggaaataccataacagcgattccggagcgcttaatggcctttttagcttcctccacgccatgaggaagtgcgatcccattgcctatgttggtgggaaatgtcagctccctcttaagcattgcctctatataggattcctccacacagccgctttggcaaagcatttgccctacctgcctgatgaccgcctccttttctccaggtctgcaattcaaatgaatatttttaagttccagaagttctgtatttttctcctcattcttttttccgtatccaaacacgcgcttaccctcctgtgtcaactttctaagtaaattataggggtgtcagctcctctttttcaatgaaaacaaaatggcatttggcgccatcagatggtgccaaatctgaaatacaggaaaaaagccggacccttttgggacccggcttctctcgcttttattcattacatcttatccagataatgcttgaaatattgattcaaatactgggaaacaagggctcttatctcctcttttcccctatatcttacggcttccaggaattcttcttcctcgaccagccgttcgcttagcacacccagtatctcgctgttttcagcagcatggtcatcctttggcaccagcatgatcaaaacaacgcttaccccttaaaataagggtcgctgaaagattctccgtcttttgtctggcagaccgaaaacaccggctttgccacgccttctgtcctggcatgaagcagggcaaagctgaaatcgggaaacatctgactgcacagctcttccctcttcataatatcctcctggatcatgatctgccggtctgcataggaagccagtttttcgctggctgctatcagcagttcctcaaaggtgatcccattgtccaccctctgatattccataaaccttatgatatttttaatctggacggctacaaaattcacctgatccagctgaatggtaaactcctggttgtcctgttttttcggcatatattcacactggcgtacctttcccgcgatccgctccatctcatcagcagaaagcagagggcttacatacaggatatcagcctcttccttaaggggcaccgttgatacaaagaaatccgtcttgctcagcacatagggagacagatccgtcattccataaacggataagtccactctgtctgaaaaatccctggcaattttggaagacatgagccgggagattccgatcccgctggcacagacgatcccgatattcacctttctccggctttcctttctgctttccatccgaacctccgccgcaccgaagtggacggcaagaaatccgatctccggttccggcacctcatacccataccggtcttcgatcacctttgcgacaattctgcaccgctcaaaaatcgccggatagtcctgcttaatctgttccagcagggggttctgaatcttcattccgttggcaagacggaccagggtgggttttaaatgtgcgatcaggccctggatcacaaattcctcatcctgctttaacaggtaggcaaggttgtcgtcatagcggtcgatcatctcattgaccacttcccacagttccctggactcctcgatctcacttcttgacttctcgtcaatattcagctgctggatcttagagcctttgatatgcagacagatataagcgcattcaatttccggaatctgaatctgaaattcctcttccagggatctggtgatggtctccgccagatcatagtcctggtcattttgcagaaagtccgccataagaggattttcctcaatgatctcctgcctgcggatccggttcaccgcgattgccacatgaatcaccagcccaagataggaatcctgggtcagattgagtatgcgcttatcccgtatccttaaaatacaggctgtcacccgttttacaatatcgtcatcaaggatcctgtaaatattcctctcacttttattctgaatcacctttagcacggactggttcctgtcctcatacatttcctgtatgatctccgtatggatgttttcatcaataaacacccgcagggcccggcggaaatcccgttcgctgccctcaataaacacgccgtacccaggctttctctttatttccagatgatacttgtgaaaccattcctttaccgcctctaaatccgagctgacagtggcctcgctgaccccgaataagtcactgtaataatacagcttttttaaggtcttgtccttgaggatttccaggatcagccgcttctggcgttcgatgcggtcggaaacatcaagggcatcatctgcttcaagctcagcctttaaggcttccatctgatcccggtccccttccagccagattccggtccctgtcttggagcaaaaggtcagcccatacttttttaatgcccttggaatgtattccagctctctttgtaccgttcttttactgatatggatctgatctgcaagctgctttactggaacaggactcttctcatccaaaagagccaggacgatctgctgcatcctgggagtaaaatcattacctgccatcttctccacctcccattaaccagttcagaagctctttataaccggacatatccgttaaattatccacagtaaagcacggtttatcaattcctgataaaaaacgggcaaaatccttctgacagacaatgacatctgcatcagccggaatgcggtcagccgacacatggaatacctccacacctgtcaggccttccagcttaagccttttcttaaacagagcaccggccatggcactggagcccatgcccacatcacagacaaaatatattctggcatgttccattctcttcgtcttcatctgcacctcttcgttcctctgtatagtttcctcatgggagactgctttccccttctttcccgacatgatcagacaggccagcaggcaggtcactgcggcggaaaccaaaattcccaaaagaatccccagccaatgctttttatccgccatgatcataatggtgataatactccctggggaagccggacccaacagtccgctgccggttatcataaaacagtaatttcccacaatgctgcctgctatggcagcaggcagaagcctgatatttgacagcacatacggaaaataaacctcatgaataccgccaagagactgtataatgaggctggaaaccattttctttctcatgtcccggtaaaccagggcatgggcaagaaggatcccaaatcccggcccgggattggtctccaggagaaacaaaatggaactgccttttgttttcatctgttccagccccaacggaaggaaaaagccgtgattgatccagttattaaaaaagataatttttaaaggctctaccacaaagctgataaaagggatgattcccttttctatcataaatgataagccatttcccaataaagtgatcagccattccgctaccggtatcagcatgaaataggccaatgccctgccagcagccccagcatcgctaagtataagttagtaaaaagcatctcaaacccagcgggaatccggtccttgatccggtccagccccttccggcagagaaaacctgcgatgctgcctgccagggcagacaagatcatggcagaagcaggctctgtcataacaacagcagaggcggcaagggtgccggccaaaccgccgacatccccgccgcacactgtgcctgctttgtatcccataaacaccggaatcaccagaaaggacaaaatattggacatttcatacaggtgctcattctggaatatgcctgctgaaaagactggcagcagccctgctgtcacaaacaaaggtatgcactcagcgatcactctgctgtaatacttcagtactctccctgctaatttcatctatgtaattccccttttgaacccaatatacataagttataagcattgtattatagctccgcagcggagctggtaaaaccgcaggttttaccagctcacgggcattcgccctatgaaataagactggaataaaatttcttatgtgcaagcacaacgaaattttattcctgccttatttcgcactgctcaacgctttcgtgtacattataccatggtttacaataggataccagaaaggctgtctttttattctatatttttgcctgtttatttttttaaggattccactaactcatcgtattccggagctgccatgaaattggtgatcagaaccagctgggcttcaggattgctgtgagccgcacgttccttcaattccttatgagtcaccacgatctgggcatcctggggaatggaggacaccggtgaatgaaccacctcaatatctccaagccctgctgacgccagcttctttttcaatacggttgcgcccatagcgctggaacccatacctgcatcacaggcgaacacgatctttttaacacttcccccagatactgttttcttttctgcagtctgatttcccttggactcctgcttcatttgtttcactttatccttagattcctccagttccccgccttttccggtaaaccgcagcagaggaagagcaacaacaaaggaaactgcagccgctacagcaacacctgccagcacgccaaagtaaccgcctcttggtgtcattgcaagaacagccaggatacttccgggagatgccggtgaggtcaatcccacaccaaggagctggaatacaaagatcccgctggctccgcctgccataaccgccagaagtaaaagaggattcatcaggatatatgggaagtaaatctcatgaattccgcctaaaaagtgaatgataatggcgccgggtgcagaactcttggcagatcccttacctgcaaggcagtaagccagtaaaacgcccagtccaggtcccgggtttgcttccagaagaaagaaaatggattttcccatttcttctacctgctggattcccataggggaaagaattccatggttgatagcattgtttaagaacagaaccttggcaggttcaatgaagatacttgccagaggaagcagcctattgtccacgaagaatccaactcctgcctccattacccggttcagcacctcaacaataggtacaactcccttcagggcgataagcgtcaggatggcgccgatgatacccatggaaaagttatttaccagcatctcaaatccggcagggatcttgttctctatctttttgtcaaactgcttgatcacccatgcgctgaccggtcctacgatcattgcaccgataaacataggaacactggaaccaacaattacgcccatggctgagattgcgccgatcacgccgcctcgctgtccataaactgccgtaccgcccgtatatgcgatcaaaagcggcagcagcatgctggccataggggaaaccaatgcccccagcgtctcattgggataccagccggtgggaataaacaatgccgtaatcagtccccatgcaataaatgcaccgatattgggcattaccataccgcttaaaaagcggccaaatacttgtaccttctctttcatatttacataccctcacttcattatatagtatttactgtgtgatccgtggaaggtatgattggccaatcaattccttttcatagccttattataatcaatatgagcttcagatttcaacacgaagaaactgggatttggcgctagttttagtgccaaatattaaaaaaatataaaatctttgtcctattccctcttaagcctctcttacaaccggcttcaaggccttgtacatagggacttctcataaaaaatcagccttaaatcagtcttatggaaatcagctttataagatttgatctcatggggaaaatgggagaaataaagcttttatggcagaaacagagtataagaacagaaagttttcctgctttgatccatatagaaaaagatgccgctcaccagcaatggatcagctggtttggggcatccctctcatataataaaaattataaatattcttttaaaagggaaaccttatcaagcttttcccagggtaagtctaagtcgtttctgccaaaatggccgtaagccgccgtctgcctgtagatcggacggcgtaaatccagcatcttaatgattcccgccggacgtaagtcaaaattctgacggatgatatccacaagcttttcattgctcagttttccggttccaaaggtatccaccataatggaagtggggtgagccacaccgatggcataggaaagctggatctcacacttgccggctaagcctgctgccactatattctttgcaacataacgggccgcataagcagcggaacggtccaccttagtgcagtccttgccggaaaatgcaccgccgccgtgacgggcataaccgccgtaggtgtctacaatgatcttgcggcctgttaagccgctgtcgccgtgaggtccgccgataacaaagcggcctgtgggattgatataaaaactggtattttcatctaccagctctgccggcagaacttcatcaaatacatattttttaatgtcagtatggatctgttcctgactcacgttctcatcgtgctgagtggacaaaaccaccgcatctaagcggagaggcttgccgttctcatcgtattccaccgttacctgagtctttccgtcaggacggagataggtcagagttccatccttgcggacctttgtgagcttaagagccagcttatgggcaagagcgatgggataaggcatgtattcttccgtttcattgctggcaaagccaaacatcattccctggtctcctgctccaatggcatcgatctcttcgtcagacatcttgtgttcctttgcttccaaagcccggtcaacgcctaaggcaatgtctgcagactgctcatctaaggctaccataacgccgcaggtatcgcagtcaaatccgtattttgcacggtcatagccgatttcccttacagtctcccgcaccaccttctgaatgtccacataggcatgggtggttatttctcccatgaccatgacaagcccggtggtacagcaggtttcacaggccacacggctcatgggatcctgctttaacatctcatccagaatcgcatcagatatctggtcgcacattttgtccggatgtccttctgtaacggactcggaagtgaataataatttttccatgttgtcatttcctccttcttacccatgtactttgggcatgcaggcatgccgcagggtgttttcctttctgccctcactcttagggcttacaggtatacccctacgtcatccctccttatatgatatgggggaataacaaaaagaaaagtccgcagcaacgcggacttgattcaacaatgtatcaaatcctcttattgctcgatttctcgctcaggttggcaccttccaatcgcgctttgtggcgaaacgccatcattaccggtcggggttgccgtgacttcacagatcctttgtatctccatcactctgaataagggatattacgtacttttcatttgttattcaattgtaagcagcatatactgcaagtacattttaacgtatttaaaaactgctgtcaagggaattctatcctttggcgaaatggataaagttcttgcaaaaatttaatcactattgtataatgacaccattctttaaatgttcgccatatgaaatctgtggagtgcgcccagcgcagaccgtggacggatggcactctggagacatctgcaatcatgcaggggccgaaggggcaagcgcttaggcgcgaaactctcaggcaaaaggacagaggcgattttttccctttctttttggaatatcgcattatctctgtttttttgtgagtgggagtatctcccactttttttatttcaaaaatcattaaggaagggaagtagaaattaatgcaagcagttgttgaattttttaacaagctggactcggcaatctgggggatacccatgattgtgctgctgtttggcacccatttgtttatgaccgtgcgcacgggctttatccagcgcaaaaccttaacagccattaagctgtccgtaacaaaagatcctgattcacctggagaggtcagccagtttcaggcgctgaccactgccctcgcttccaccataggcacgggcaatattgtgggtgttggtacggcagtattcttaggcggtccgggcgctgttctctggtgctggctgaccggtgtattcggcattgccaccaaatatgcagaatccctgattgcggtcaaataccgtgttcagaccagggacggccgcatgcagggcggagccatgtatgtgctggaacgggcattgggtcttaaatggctgggcatactctttgcactgtttgctctgtttgcatcctttggcattggaagcggcacacagatcaacgccattgccgagatcattgaaaacaacgtgcccctgcctatcccgcgcattgtaatcggccttgtcttcggcgcgattaccgctgtagtcattatcggcggcatcaagtccattgcaactgtgtgcgaaaagcttgtgccgtttatggccattttctatgtggccggctgcctgatcattctgtttatcaacgctgacttcatcatacctgcactgaaggcgatcatcaccctggctttccagcccggcgcggttgccggcggtctggtcggacgcggcattatgcttgccatgcagtatggtattgcccgcggcctgttttccaatgaatccggtatgggttctgcaccgctggtggcttcggccgcacagactcgaaatccggtgcgtcaggcactggtttcctcaaccggcaccttctgggatacggttgtcgtctgccttatgaccggtctggtactggtttcaaccataatgaaaaatcccaacatcaacatggatatgatccaaaacggcggacagatgaccactgccgctttcagccagattcctgtcctggggccggtgatcctggtaatcggcatcatcacctttgcttattccaccattctcggctggtcttattacggggagcgctgctgtgagtatttattcggcgccaggggcatgctgccttataaggtcatctttgtggctattgtagttgtaggccctgtgctgtctctggatctggtttggactatctccgacatcttaaacgctttgatggccatccccaacctggtagctgtactccttctgtcaggtgtcgtggcaaaagataccagatattatttaaaccacttagacgaaagggacgaaacaccgattcctgtggtggacaaataaaaatggaaaacctcctgcctgtcatggactggggaaaataattctgccaataaattatttatcccgcaatcccacgtaaggcaggagtttttttaattttaacccttgaccccgcctcctgtaatgccggcgatgatcttctccgacaaaaagatataaaggataaaggtcggaagaaatacgatgataaccgaggcaaacattcctgaccagtctcccgtatatttcatggaattgatcatggaatacagtcccaccgcaaccggccgcactctgtcggagtttgcaaaaatcagggaaataaaatactcattccatatattgataaaattgaaaattgttaccgttatgatcccggactgggccatgggaaacatgatcagccagaatgccctcatgggaggacagccgtcaatggcagccgcttcctcataagccctggaaatattggcaaaaaatgtgagaagaaaaatcgttgtataaggaacgttgatccccacgtaaaggaagatcagaaccgccttattggcaatgtagttgttcaatacgttcataccggctatcaggctgaacaggggaagaacgatcatgaccacaggcacgcccatggcggataccaggctggtctggatcattttattccctgcaaatctaaaacgggacagaacgtacgcagcaggcgcacagatcaataccagaagcgtacacgaaataacagaatacatcagggaattaaagaaaatagcggacacattggaattggtccatgcctttgcatagttttcaaaatgaatcccctgggacaggacatggcctgaaaaaatggcctttgtggtagaaaagctggcggccaccacccagcccagcagtacaacggtaaataaaatccaaacaatcaggagcagatatcccggaaaaagcctaagctctctcttccagttaaatggctccataaactttccttttctagccatagattcccctccttagaattccagatcatcatcttttatcagtttattgcatatcaggaagacccctaccacacaaatacttaacagaacaccgattgccgctcccaagccagcattccgttccgtcatactgttgccggctccaaagatcatcatgtacatgtaaaccatgggggtgatggtctgggtatccgccgtaaccgttgagaacagctgagaccagacgaagaaacctactgaggtgacgctccacatggtaatgttggttttaaacaccccttttaacaggggaagggtaatatagcggaactggtttaccttatttgccccatccagggtagccgcctcatagtagtcatccccgatccgttcgattccgcttgcaaatatcagcatatgatatccaaccatgccaaaacagtacgcaacaagcaaggccatgaatttatgatcattatcaagccactggaccttggacaaaactttaagtcccatggctgaaaatacatttttaaggagaccgaacttagggctgtatacatactgaagccacatggtggcaagggcaaccgcgctgactacgttgggaagatagatcattgccctgaaaaagcttttaaaacgtatcccgctggttatgatgaccgcaaataaaagacccagggacatgacgatcaatccgccgatcagccagatgcggaacagattccacatggatatgcggaacaagctggtccctgcaagcttgctgtaattggcaagtcctgtgaactgccacttggccatagaatccgtgattccttcgatcttaaaaaagctcattaaaactgttctgagaataggataaaggaatacaaggacaaacattaggactgccggtatcagaaatacggcaatcatggtcttattcttcttcacgttaaatacctccccggctttccttaattacacggtgacaccgccttggcggtgtcaccctatagaatcttattattccggattatttgcctgctgctataagagcgtccacgaactctgctgccgtaacggagcctccgcaaagcttcataaagttctctttgataataggtgttaagtctgcattggcttctgctcccgctgcccatggataccgcactgtcaggctttccattacaggctttacgctggcaagctgtgccggccattctgcatttctggtatctgcaggaattcccattgacatttcggacattttcttgtcaaattcaccctgggtaatgtactggatcagcttaaacgcattttctccattttgggaattcttattgatggccagaacctgagcgccgtagttggaggcattggttccatcctttccgccttctactgcagggtaactgaagcagccccatttaaagtcttctcctgccatatcctttacttcgtttggaagccaggaaccgtttaaatacatggcggctgttcccagggcaagctcctggttctgtcctgcaggccatacgttagaagcgatggtctctgaaaaataccctttctttgcgaaatcctcataggcctgagccgtcttaaggaccgccgggtcatcccatttgccttccttcacaatggcttctgttcccggttcacctaaaagtctggacatatgatagccaaacatagctgtaatgtaagcatcatcacaggtaattggggtataacctgcatccttgatcttctggcatgccccgtcaagctcttcccaggtctttggcacatccttaattcctgcctcatcaaaaatggactggttatagaagaatgcgaatacattgggctggtaaggaatggactttaatgtaccgtttcctacttccctgcaggctgacattaagcctgcattggcattgtcttcatagccggaagcctttaccagttcctccagatccattaaatactgtccccatgtggtatttacacggtcaatatcctcgtcaaacaaatcgatgttggttcctgcatccaaggcaggctgcaagccttccctgattcccgtacgccccttaaactgaacgtctaccttgactcctgtatctgctgtaaatttgtcaattgccatctggatcgcctggccctgaggctccgttgcctcccacatggtccagtaaacaagcccgtcaccgccgccagctgtttccccttccgtagaagccccggcggccgttgtggcagctgtggaagcccctcctgcacatcctgccagcacaccggcagccatgacagcactcagcataatactcataaaacgtcttctcataattttacctccctctgttatccaacctttttgtcagatgttcttggtgagtctatattattatacttttgggcaaaatgctttgtacaaaaggttatcattttttacattttaggttttttgtttgcttttttcataattagaagttaaaatacaggtaacttctatgctatttgcacaacatcattttataacaggctttattctgcctaaaaatcagggggaacgtatgaaatacaagtatacagaattgagagaagagctgaccatacaccggattatcagcatccactattttgaatatatgagcgacttcacctttgccggggaatctcataacttttgggaattgctgtgtgtggataagggagaagtggacgtggtagccgatcatgaacggcttacccttcaaaagggagaggtcattttccatcagcccaatgaatttcaccgggtcctggccaatggggtcattgctcccaaccttgtggtcattggatttgactgccagtcgccccacatggcttcatttaaagaacagatcttaaacgtagaccaggaggagcaggagcttctggccaggatcattgcggaagcgcgcttatgctttgacggaaggcttgacaatccctatcaggaggttctggttcgaaaggatcacggaccttttgcagcagagcagatgataaaaacctatctggaacagttcctcatacaaatgtaccgccactccctgtccgtccggcgggctcccgccgttcacaaggacacctcttccgcagaggacatctatgaaaccatccttcactattttgaaaagaacatctgcacccagctgaccattgaccagatcagccgggataatctgatcagcacctcacagctgaaaaagcttttttatgaaaagggaaacaccggggtcattgaatattttaacagcatgaaaattgatgcagccaagcagctgataagaaacagacagcttaattttacccagatcgccaatcacctgggttatacctcggtccactatttttccaggcagttcaagcatttgaccgggatgaccccttctgagtatgctacttctataaaaaaactatcggagagaaacatgctgcgggatacagctctttaggcctttgcctgtgaccgcttcatttgattaaagggtcatagttttttcctatagatactgatatttttttgatattacgttataaccaggtcctcatgttattatttatagtaaaataacttgaaaggattttcgctgtatgaggacatctgttgtcggctacccaagagtgggggctttaagagagttaaaattttcatctgaaagatattttaaagaagaaatatcctctgatgaattgcagacaattgcaggaaatttaagaagtacacactggaacacgcagcagaatcatgggattgatttcattccaagtaacgatttttcattttatgatacagttcttgacaccgcagttctgttaaatgtgattccggcccgataccgcagtctggcgctgccgcctcttgatacttattttgccatggcaagaggctatcaaggtgccaacggggatgtgaaagccctggccatgaaaaaatggttcaatacaaactaccattatatggttccggaaattgatgataatacagaaatacgtcttgcaggaagtaagccatttgatgagtttgaagaggcattgcagctgggaattcaaacaaagcctgtcttaattggagcatttacctttttgaagctggcaaggtttaccggtgaaaagcacacgaatgattttactgaggccatcataagagcttatcaggaaatacttacaaggtttcatgaacaaggggccaaatggctgcagtttgatgagccaagccttgtacacgatctcacccatgaagacattctcttatttaagcagctatacagcgccatcctatctgaaaagggcaccgtaaatgtgcttttacagacgtattttggcgacatacgggattgttatgaggaaataacgggattggcttttgacgggatcggaatggatttcgttgaagggaaggaatccctggagcttataaagacaaagggcttcccctccggtaaggtactgtttgcaggcattgtaaacggcaaaaacatctggaaaaataattacaggaaatctttcaggcttatctctgaattgcataagcattgcagccatattgttcttggaacctcctgctcgctgttacacgttccctataccttactgaatgaaacaaagctgcctgagaaacaaaaatgctatttttcatttgcaatggaaaagcttaatgagcttaaggaattaaaagaaatttgcctatctcaaagccctttagaaacagaggaatacaaaaaaaacgccggtttgttgaagggagacagaaattgcagcaatgaaaaagtacagcaaagggtacggaaaatttcggaaagtgatttgactcggcttccggaatttgcggttcgtgaagagcttcagcaaaagagcttcggacttccatgtttccccaccacaacaatcggttcctttccgcagacagccgaggtaaaggccaaccgcaccgcctttaggaagggcagcattacagaagcacaatactgtgattttattaaggaaaagatttttgaatgcgtcaaagtacaggaagaaatgggattggatgtattggtacatggagaatttgaacgcaatgatatggtagagtattttggtgaatgcttaaatggatatttgtttacggagaagggatgggtacagtcctacggtacccgctgcgtaaagccccctgtcatttggggtgatatttccagggaaaggcccatgaccgttgagtggtctgtttatgcccaaagactgacccataagcctatgaagggcatgcttacagggccggttacaatactgaactggtctttcccccgggaggacatttcactgaaagaaaccgcgttccaaattgccctggccattggcgatgaagtgcttgaccttgaatcaaacggcatcagaatcattcagattgatgaagctgctcttagagaaaagctccctttaaggaaatccgactgggacagggaatacttaagttgggcgattcctgcattccgtctggtacacagccgggtaaaacctgagacccagatccatacccacatgtgctacagtgaatttaccgatattattcctgccattgacaatatggacgctgatgtgatcacctttgaagcttcacgttcggatttgatgattctggattccctgaaagaaaatcatttcaagacagaagtggggcccggcgtttatgatattcactctccaagagtcccgtctgtggaagaaattgaatcagctttgcatgagatgcttaaaaggctgccaaaagaaaagttatgggtgaatccggactgcgggcttaaaacacggcaatatacagaaacaaaactcagtcttgaacatatggttcaggcagcaaggcggttaagaaatgaagctgtctaacatcctaaaaaaacaggtaactctttcctttgaaatctttccgcctaaaaggaccggatcgattcagacaatttacgatacccttgatgcgctgcatgaactaagtcctgactttatcagcgtgacctacggggcgggcggcagcggtaacagtcacgctacctgtgaaatcgcttctgcaattaaaaatcaatataaaattgagagcctggcccatttaccttgtgccggcctgacaaaagaagatgtacttactcagctagaaaattttaagcaaaacggcattgaaaatattcttgcgcttcggggagacattttagatcccaaacagcccaaaggggattttacccatgccagtgatatgattgcgtttattaaagagcatggagattttgatataacagcggcctgctacccggaaggacatacagagtcaaaaaatctcgttgaagatatccaaaatctgaagaaaaaggtggattcgggcgctgatcagttgattacccagcttttctttcataatgactatttttacagatttcaggagcgttgttccattgcagggatccacgttcccattgaagcaggcattatgccggtagttaataaaaagcagattgagcgcatggcatctctttgtcatgtggacctgccccccaaatttattgcgatgatgaaccggtacgagaataaccctgaggcaatgcgtgacgcaggcattgcttatgcaattgatcagattgttgacctcgttgttcagggtgctgacggcatccatctttacacaatgaataacccttatatcgccgcaaaaatatatgaagcagttcaccggctgatttcaaaataatatttaagctgttgttccggcaaatcgaatgatccgccggaacaacagctttttctttacaccacaaattttatatacgtccggtcatcaatggaactcttcccgtttgtgaagccggatccggctttgtagcagtcaatacataatgggtccttttccttcagctcttttaaaaacagctcactttcctgtaatgacggctctaaactgggatatccgtcagaggccaatataaccgtatccccagctttcacatcagctacgattactttggagaaatcatcacaaaaaccatctaatacgctgaattcgtatttgccgcctttatcacaattggaaaaatataattgatttcttatgaaaggcagtaatatttcctgggagggatccgaaaggcaaagctcctctgccgatttcccgctgatcagtaccgaatgcagataagcggatcttacctctgccaataacacatcaatctccatttcttttttaaacgactgcccgtttattctgaactgacaatctccaaagcaccagatctgcttgtgtctctggctgtatattacaatggttgaccgcaatctctccgcagtatttttaagaaaataatcttcattgccattatattgcttatgaagctgaaaatataagtattcaagcacctgagacgcaccttcctttccatctaattgttccattgctttgatcagaatttcctttgcatgaaatccgctggttttattgttccataaaatttcccctttggcagttaccccatccataactgcaataaatttatcattgataaacagaccgtcttcacacaaagcatcctcaccgtatttagaagcaataaacttttcaataatttgcatctctgttatgtatgcagtatacaagcataccttcctttcttaatttttcaccagaggttctattgtgagcataacacttaaaacatcttcttacagctgcagcaaggtaaaaaaaaagtatccgcccaacgaatgataatcataaggatagatactttgacaacggaaatcttccgctttaattataataacgtatatagtcaggattataatatttcaaattcctgctcctgattaagaactggttgtatatcttttttcatttgatttattttcattcgttttaacgaattcatgaaatccaaaaggaaatctatcttatttttcattccctgaatttccatctcaacacttccgctctcaagattttttatccaacctgtcagttttaatctcaatgccagctgttcaatctccagacgaaaaccaacgccttgtactcttcccgaaaaaaccatatgataccgtatgatctcatccggttcaaattccagaatattaattcctttcacttggttaatgacataattattcctgatctgcttaaacatctttttaattttcatctttaacctcaaaatgatttgaaattttatcaatagaaagtgaaatatatgaaaatgcaatcattccccataagcatctgcccccggctgacctacagccaggtcagccgggacatgatgcaggaagcaagctttcaggcttttagtctcttacctgtacccatttggattccctgactgccatctccaggagtcctggcacatttcatcaattccacgctccgcttcccagccaagttctttctttgccagggaggcatccgcatagcattctgcaatgtcacccagacggcggggcttaatggaatatgggatgggtttcccgcatgcctttgaaaatgcttggatcatctgaagaacgctgaaaccctgacctgttcccagattgtaaatccggacttccggttctgaagaagcaattttttcaagggcttttacatgtccgatggccagatccaccacatgaatgtaatcacgtacccctgttccgtcaggcgtgtcataatcgtcgccaaatactcccacctcttttaacttgcccacagcaacctgggtgatgtaaggagtcaggttattggggattccagcaggatcctctccgattaaaccgcttttatgagcgcctacaggattaaaatagcgcaggaggattacgctccactccggatctgcggtatgaaggtccgtaagaatctg
